United States Patent 7,745,391 (HUMAN THROMBOSPONDIN POLYPEPTIDE) - sequence listing, part 191

SEQ ID NO: 456888 - DNA, 2710 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggatccgcctcctgggtttaagcgattctcctgcctaagcctcccgagtagctgggattacaggcacgtgccaccacgcccaactaatttttgtatttttagtagaggtggcattctaccatgttggccaggatggttttgatttcctgaccttgtgatccccccgcctcagcctgccaaagtgctgggattacaggcgtgagccactgagcccagctatagatgtcttaacatcattgttttctgttcttttgttccgggtaataataaggagctgaggacagctgaggaagggcttggctgacaaaatgccttccgacagagccctaactactccacgtaaacctaggacagtctcaatggtagtaactttgaacactgcatttgataactttcaaatacaacttggctctttttcattaaatggtatgcttctctataacaacacaataaacaacttcttacctcactttctttttttgagacagggtctcactctgtcacccaggctggagtggggtggcatggatcacagatcactggagcctctacctcccaggctcaagtgaacctatcttagcctcccgagtagctgggtccacaggcatgtgacgtaccaccatgcctggctttttttttttttttttttttttgagacagggtcttgctctgtcacctaggctggactgcagtggcacaatcacgtctcaacctcctggtctcaaccagtttccaacttcagccttctgagtagctgggactacaggtgctgagccaccacatccagctaattgtttttgttttttgtttttcggcagagatgaagtctcactatgttgcccaggctggtcttgaactcctg

SEQ ID NO: 456889 - DNA, 2225 bp, Homo sapiens
aacttaggctaggtacgaggctgggttcgaatcggccgaggagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456890 - DNA, 1540 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctga

SEQ ID NO: 456891 - DNA, 1329 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccaggcttggtgttaggacaggagaaagcaggcctgtgggctggaggccgtcacagggccgtcaatgcagacaaagggatgatctctcgagtcttgcaagccggga

SEQ ID NO: 456892 - DNA, 3537 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctggtaagggctacagctggggccatggactagggcccagtgggctggggggagccgtgggaccctttgttccaccagaggactttgatttacactgaggttgcccctttgactcctgtttgtctgctgtgaagtttgctgcctagatgtgtatgtagacttttcaccctgtccaggtctcccgaaagagggagcagttggcatatggtaggatcagaaacatccatggggtgggatcccaacagagagttggggagagaagcccttagatgctggttgttaacagttttcctttttggatataacagccttgcatagtgaagatgttccttgaaaagttgtctttacattaggtttttgtgaattgaaaggcatttcattcaaccatgtgtggaatgtggttgctggcattccagacaaccacagtaactaagccacagccttttgtaaaatgccatggttcaccttgatcttcagtccagcgtgtatttacagagaggcttactgtgccaagctctgtgccgagtgccaagcacgattgagttccccagcaggggatataagataactgacctagtccctggcagtagaagaataaataagctgtggttatacaaaaggaaatttcagtgagagaagcttgtaggaaagacaggcattggagttgatcctggaaggatggagagactttgaatgactagttcagggaatctgagataaagggaaatgtatgagcagagatatatccaagcaggagttagtctggtcctgctggaccacagagggctgtcatggaagatgactatggaaatgttggctaggtgagattgggaggggtctgaatgttcctcagagaagggagggaaagaggaagaggagctgtggaaaagtcttttgagatggaaagtcgtgattatcactgattcccctcaagtggcttgggttacctactcttgctatagttctcagtgcttgaatattgtggttggcctcaaacatctcaaaaggaagtgaaagagaagtgatggagacctttctgaggatctggcttaagtaatgtcatttctttgtgtatttcagaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456893 - DNA, 2404 bp, Homo sapiens
ctggcgatttcattcatgggacagtcattccacttgtagttacatgaaaaaggcattcattgcatttggccgttgtgtggcttctgatgtaaatatgtggcttgttcgatttcagattactggttcatgtttttttttttttgagatggagtctcgctctgtcgcccaggctggagtgcagtggcatgatcttggctcactgcaacctccacctcccaggttcaagcgattctcctgcctcagcctcccaagtagctgggattacaggcacccgccaccacgcccagctaatttttgtatttttagtagagatggggtttcattatattggtcaggctggtctcaaactcctgacctcaagtgatccaccagcttcggcctcccaaagtgctgggattacaggcgtgagccaccacatctggccttactggttatttatgatatgacacatgaacatggagcatgtgtccaggtgtggaacttggcttataggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456894 - DNA, 2406 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaaacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456895 - DNA, 1792 bp, Homo sapiens
caccaatttgaatatacttaggatgtatattctgtagtctccttttcattcatcccgccaatcttgcagtgacctagcttcgtgatatatttctttagctaggtcctaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456896 - DNA, 1634 bp, Homo sapiens
gttgatttggagttccagggtgatactgtctgagtcataaatgatttatttgtgaatttctgtggctggtcacgtattttggtcctgtttgtatttcccttcccctctctgtgtctccttatagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456897 - DNA, 665 bp, Homo sapiens
accacaaagacctgtgtgtttatctggcttagccattatgttaccttgggccagatactaattaagagattaaaataaccacagctcctggcctctttttttgtttttcctatcccaagttgtattactagttttggggagtttgcagacaattgaatattctataggctgtgttgcagctttagatggatcgacctgtcatgtttttgaggttatccaggctgtatatctctggagagaagggaatggcaaagagtgggagtctgagtcaagtttggttttttttttttaagagacaaggtctctgtaatccaggctgcagtacactggcatgaccatggctcactatagacttgggctcagccaatcttcctgcctcagcctcctgagtagctgggtttggttttccccagggccatatgtcagcttatttaccctcctcacttggtgtctcccagcctgccagcccatgctgttcatccagtatctgctgaatggtgattacctattaagtggaactaacacaaaattgcttatctaaaagcaattattggtgattatttccttgcagtggcccactagagggcgccattgttaagtgtaattccagtaggtgttttgtgttttttttttttaatggaataaactgaaatctttacatggta

SEQ ID NO: 456898 - DNA, 500 bp, Homo sapiens
tattttctgagtggaacaaaaacctcttcccttaatggagtggctgcagacagccacgttgatgtacatggagtaggcagaggactgctgcagtatgctgactttcacaaccctgggtcctgcggactcttccttggcaggacgtggacttgagctgtcctgccaggaccagacatggatttgcacccagctccacccatctccttacctacccagaggcacacatctcacaggcaagatgagtgtttggggttcaggtatgagctagggtcatggaacaacgcagtgctcctgggccagcaggaggctccagctcacttcctcattggcttcagcttctctaatgtctggcacatgagttctggcttagagtgcaaggaagactgcaaagggaaatgacagagaagagtattgaaggtcaccttctgctgggatgtatgaatagcctctgagtcccaaagcgttctctgcaaaaatgtgtactatgtgtatgcatgtag

SEQ ID NO: 456899 - DNA, 524 bp, Homo sapiens
gtggtctgtttatggttggtttcttttctgaacaaatgccttttccctttttcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaa

SEQ ID NO: 456900 - DNA, 1006 bp, Homo sapiens
  misc_feature (881)..(882): n is a, c, g, or t
  misc_feature (886)..(886): n is a, c, g, or t
  misc_feature (891)..(891): n is a, c, g, or t
  misc_feature (894)..(894): n is a, c, g, or t
  misc_feature (900)..(900): n is a, c, g, or t
  misc_feature (914)..(915): n is a, c, g, or t
  misc_feature (923)..(923): n is a, c, g, or t
  misc_feature (933)..(935): n is a, c, g, or t
  misc_feature (937)..(937): n is a, c, g, or t
  misc_feature (941)..(941): n is a, c, g, or t
  misc_feature (965)..(966): n is a, c, g, or t
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagaggagaagatctgcagaagatgagcttgcaatgagaggtttcttacaggaaggggaccttatcagtctaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaagnnctcnttaangcngaaatnggggggattgtggnnggaaccgncgagtttgcnnngnggtnaggggggcccaaaccggactgggnntgcggagtgcaatggtttgtgtccatgggaaaaactaaaa

SEQ ID NO: 456901 - DNA, 2242 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgatgagcccagctatagatgtcttaacatcattgttttctgttcttttgttccgggtaataataaggagctgaggacagctgaggaagggcttggctgacaaaatgccttccgacagagccctaactactccacgtaaacctaggacagtctcaatggtagtaactttgaacactgcatttgataactttcaaatacaacttggctctttttcattaaatggtatgcttctctataacaacacaataaacaacttcttacctcactttctttttttgagacagggtctcactctgtcacccaggctggagtggggtggcatggatcacagatcactggagcctctacctcccaggctcaagtgaacctatcttagcctcccgagtagctgggtccacaggcatgtgacgtaccaccatgcctggctttttttttttttttttttttttgagacagggtcttgctctgtcacctaggctggactgcagtggcacaatcacgtctcaacctcctggtctcaaccagtttccaacttcagccttctgagtagctgggactacaggtgctgagccaccacatccagctaattgtttttgttttttgtttttcggcagagatgaagtctcactatgttgcccaggctggtcttgaactcctg

SEQ ID NO: 456902 - DNA, 1903 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456903 - DNA, 2370 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagagaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456904 - DNA, 2391 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtctaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcacttgggaagctgagtgggcagatcacctgaggtcaggagttcaagaccagcccggccaatacagtgaaacctcgtctttaccaaaaatacaaaaattagc

SEQ ID NO: 456905 - DNA, 1165 bp, Homo sapiens
aagacagttttggtaaaaagtcacacgccacacaacgtgagattttattattccacgggtgcttccttgccaatagtagacatggcagctcggctcccttcccttcgggttcgccttattgttgccaattgtaaacatggcctctaggccgtgagttctcattggcagctgctctgagtccccgcccttccccgcccctccgaacgcggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgtatcctgcgctttgcactccagcctcttgatgcttttctgtgggactgggaaatgggccttccattgtatgtctctgacggaagaaccatgtcatccttgcagggatccgagtcttagaccaagtgtcgggctctgctgcatcctttctcagtctccttaattcaggctgactccccagctcttgttgggacctgctgctaagtcatttctttgggtcttgtaacttacggtggcctgtgctttagactaggcttttgttaatggtgttaacttttagcgcagggagtggagaaggtgttgttcacgtcaagatattaatgacaggccgagtgtggtgactcatgcctgtaatcccagcgctttggaaggccaaggagggaggactgcttgagcctaagagttcaagaccagcctgggcaacatagcaagacccccctctctacaaaaaaattaaaaaag

SEQ ID NO: 456906 - DNA, 7508 bp, Homo sapiens
  misc_feature (8)..(8): n is a, c, g, or t
  misc_feature (872)..(872): n is a, c, g, or t
  misc_feature (1688)..(1688): n is a, c, g, or t
  misc_feature (1765)..(1765): n is a, c, g, or t
  misc_feature (6182)..(6182): n is a, c, g, or t
tgctcacntctgacagccagacaagggctgtgctcaggggcagctcggctgggcacacagtaggtgctttagcggacagcactgaggcccccagcaagaagcccatgagctcctccccctcccgcagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctacgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcaacccagaccgggacatgtccatggcgtcctggctgaatctggctgagattgcgcaggtcgtcgagaaggtgcaggaggcctacaacacctggcccagctgctggggcggccgngagcagaggtgcatctgtgtcgtttcccacggtgcccaggtcagtgcactgaggcaggagctgaggaggcgggacctaggccaggtgtctgtcggcagttttgagatcctgccagggcggcagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacacngtcgccaggcccgagtccctgcagcaggcccggctgtacgagaacctgcccccggctgcgctacggaagctgctgcncgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgctggctcccacggccagcccacgccccgggcccagcagcctcggccctggcctgaatgttgaccccggcacgtatacctgggtggcccacgggcagacggaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagtgatccccagcaggttcctggagcggcagacctacaacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaangtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgcggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcatctcac

SEQ ID NO: 456907 - DNA, 2234 bp, Homo sapiens
  misc_feature (908)..(908): n is a, c, g, or t
gctccctggagaagagctcttctccaggtcctccctggagaagagctcccctctctgcaggggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaangtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgcggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcatctcac

SEQ ID NO: 456908 - DNA, 1133 bp, Homo sapiens
caggaggcaggctggccaggcaggctgatggcggagggtggtggggagggtgggggggccctggactttccctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgcggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcatctcac

SEQ ID NO: 456909 - DNA, 1486 bp, Homo sapiens
  misc_feature (160)..(160): n is a, c, g, or t
gcggcagcagggcctcacctcccatcccgcagggagcgagtggcgctatgtgctggtgagcaccgtccgcacctgtgccaagagcgacctggaccagcggcccaccaagagctggctcaagaagtttctgggcttcgttgtggaccccaaccaagtgaangtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgcggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcatctcac

SEQ ID NO: 456910 - DNA, 412 bp, Homo sapiens
ccctcacggattacctcaagccggccgacacttagggaaaatagaaaagaacctatgtgaatatcagggcagattccccaataggtcaggatggtcagtgatgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctc

SEQ ID NO: 456911 - DNA, 2921 bp, Homo sapiens
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctc

SEQ ID NO: 456912 - DNA, 2856 bp, Homo sapiens
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctc

SEQ ID NO: 456913 - DNA, 2320 bp, Homo sapiens
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgttta

SEQ ID NO: 456914 - DNA, 2867 bp, Homo sapiens
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaacgccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctc

SEQ ID NO: 456915 - DNA, 968 bp, Homo sapiens
  misc_feature (816)..(816): n is a, c, g, or t
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgnggttggcgacggggagagaagccacgggagtaaaggcaagcgtcggacggacaggggggacaaaggggcgggggggcccgggctggggcgaaccggcgcaccacgcgggcgggtgaggccccaatgacacacacggcagacagcaagaacaa

SEQ ID NO: 456916 - DNA, 736 bp, Homo sapiens
cttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggtgagcagaggatgcctccgaggaatgagggggcccaccaggtggggggcggcgtgtgccagggcagagttggaggagggcaggagatctgcgtatgattccagggggaggtctttgatgcacggctggggcatgcccttggcagtgggagccattggagatgtgccgcaggactgggacaggatggggtcgtagttgctgtgccaggccctctggagacg

SEQ ID NO: 456917 - DNA, 2770 bp, Homo sapiens
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctc

SEQ ID NO: 456918 - DNA, 2897 bp, Homo sapiens
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctc

SEQ ID NO: 456919 - DNA, 2867 bp, Homo sapiens
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagccctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctc

SEQ ID NO: 456920 - DNA, 997 bp, Homo sapiens
ggtcggtgcgcgcttctcccgaggtggaacgggcggcagtcaagcgccggcgttctctgccatcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatcgtaaaaagcatacatgaaaggtatacacagggacaggaatggataccagattggagaagaacttccaagagagatgatgccacggcaaatacctgttaaaaaggccaaacgcaaaaagggcaaaggacgccggcaaaggccaccacttcactaattactgacgatgtgctggaccaccaactgggggcactcggcaacaacggaggcgacggtgacaaaatccgagtgcggacatcgaggagcaacgcaggacgcgcccgacccacgttcacgaacggtggacgactgacgagacgatgccttcgcgacacacggcggcactgagagcaaacgcggcagcggaagcgcccctacgccagccggacacgcgatgactgggcgcaccgctgacacggtagggaccccatgaccgacgtgacacaccccatacagcagccgttgaccgatcaccatcgacgggcgacgtgggccgaccaccgcaccagacgccgccacacacaaaacgagagctcaaagccttcgccgactacgacggccccccagacgccagggcagaagcaa

SEQ ID NO: 456921 - DNA, 3307 bp, Homo sapiens
  misc_feature (984)..(985): n is a, c, g, or t
  misc_feature (1010)..(1011): n is a, c, g, or t
cacctggattatgttaacagcaagttagcaggccacatcattcagaagatacgggaaattaatattcttgagaagagaggaaattagacactacctgagagggtggggcatccagctcctaatgaaaaacaacttttgataacacggataacacagtactatcaccttcaaagtgtttgtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtataccaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggtggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacgtgatgacaacatggatgaggcaacctattaggcatgaaatttttcaaaaaatatttttatgatgcagcttctgaacatttggacagacttgatttgtattttatttctgataaggaataagnncttgtttctgttgttttggacaaanngttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaac

SEQ ID NO: 456922 - DNA, 3259 bp, Homo sapiens
  misc_feature (936)..(937): n is a, c, g, or t
  misc_feature (962)..(963): n is a, c, g, or t
ggtcggtgcgcgcttctcccgaggtggaacgggcggcagtcaagcgccggcgttctctgccatcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtataccaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggtggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacgtgatgacaacatggatgaggcaacctattaggcatgaaatttttcaaaaaatatttttatgatgcagcttctgaacatttggacagacttgatttgtattttatttctgataaggaataagnncttgtttctgttgttttggacaaanngttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaac

SEQ ID NO: 456923 - DNA, 502 bp, Homo sapiens
atgcctcaggattattagcagctaagcagagttagaaaagattaataactgatacaaaaggctattcatttgattctagtgtttactgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456924 - DNA, 669 bp, Homo sapiens
gcgatatccgtacacttgcctcttctacccttagaaaattgactaacagagggagcaaaataaattaacattctgatgaatatatatggatggacatatgttcatgtgcaatggaggaagggaagaggggctgacaccagctaaaatgattcaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccaagtctcccagagccaaaatgtgtgaagattggtgcgttagaaggatatagaggccaaagagtaaaggtgtttggctgggtccacaggctgcgcaggcaaggaaagaattaatgtttctggtgtt

SEQ ID NO: 456925 - DNA, 377 bp, Homo sapiens
gagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgacagttctaaaccgacgttagtttgggactggggccaacactctatactacc

SEQ ID NO: 456926 - DNA, 2797 bp, Homo sapiens
  misc_feature (67)..(67): n is a, c, g, or t
caacagaaacgacagggctagtgtaaaaccggctttaacgaggcagtactatacggctaggtacganggctgggtgtgcgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456927 - DNA, 3360 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgaagtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcaggtacgtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456928 - DNA, 3119 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaatctttgctggcttaattttcttaaagctaaacatctctttgtcacattcgttcatgcttttgcaattattttatcttttttatgatgtatatatgtgaaattaagtactactaaatttagtagatattgctaacgttatatggtaa

SEQ ID NO: 456929 - DNA, 3298 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456930 - DNA, 2927 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456931 - DNA, 2319 bp, Homo sapiens
ttgtttatttcaatttgacaggtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456932 - DNA, 2512 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatga

SEQ ID NO: 456933 - DNA, 1844 bp, Homo sapiens
  misc_feature (67)..(67): n is a, c, g, or t
caacagaaacgacagggctagtgtaaaaccggctttaacgaggcagtactatacggctaggtacganggctgggtgtgaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456934 - DNA, 2334 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttggtaccaagggggtaccattcctggttccttgctactaccatctatttcaattccgtaactcagatgaattaaggggggctctctgaacaaattccttatttcctagatcgtgaccactacggggagacacggtagaacagtctagggaatatcgcatatatcccactagcaacatcatcggagttatataccacacactggctgacagcacgaattcgtcctctcctcgtacttcacacgcacaacgcaccggtgtgtcccctcc

SEQ ID NO: 456935 - DNA, 1906 bp, Homo sapiens
gagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456936 - DNA, 1184 bp, Homo sapiens
  misc_feature (18)..(18): n is a, c, g, or t
  misc_feature (56)..(56): n is a, c, g, or t
  misc_feature (69)..(69): n is a, c, g, or t
gtagtctgggcttatggntttgggggcagaataccaccaggcgaggttcccatctnatcacattatgtnaggaattgtttcacatcaacatgccttatcacttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456937 - DNA, 1831 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaaatatccagaaggtcctgagagatggtgacaggacacattatggacatcttgtgtgtgaattctgtggggatcagtcttttatggaggagtctggagatccggctaatgaatgggagtgtgttgccaaagtgggaatggggagcaaagggatttgattaaaaatgggggtaaggagaggtgccccctatggtagggtaacaaggtttctgggcatagggggagaggttaggttttcaaggatcaatgg

SEQ ID NO: 456938 - DNA, 1610 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaaattagtgcaaacaccaggtcgacgctggggtgcccactcttaaagctggacacattggggcgaaagcgcgacaggaacaaaagccacaagggcctggggaacgaggacccaacaccgtgagaaagtctcgaaagaagcacacaccaccgggagagagacaacaaaagagacgcggagacaaccacccggggagcggagggcaccgaagcgcatgaagaacacccccaacgcaccacagacaaacaaccaggcacgacaacaacaaaaaccccacagcaagaaagaacagatgacaacccaaaacaacccacgaggataggacaagaaacacgagggaccagaaaaagaacgcaatacgaacgacacagaaacaacaacaaggaacgaagaggccacttgtgttgcgatcacccacgtctgtctcatagcactcaatccaagcacaccacgagacccgcgccgg

SEQ ID NO: 456939 - DNA, 2973 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456940 - DNA, 3193 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaaaaaaaaacaaaaaaaaacaaaagtggggcgcgcgcccgaaaagttcaaaccacgtggggggggcacagaagagaaggcacacggccaagagaacgcaaaggggggtcccaaaaaaccgggagggggaaacagggtgcggacggtccaggcagaacaacaccgggggacaacacacgtgacacacagcacaagaacaagcagacacaagagaaaaaaggat

SEQ ID NO: 456941 - DNA, 3020 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaagtattgtacaatgttcaagaactgtcttttctctcctccctacccaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456942 - DNA, 2926 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456943 - DNA, 3544 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcaggtaaaaccaattttttaagtactcaacatttttttccactgtaatcgttctgtatatattgaaatttttaaaaggggagaattcagggtagtactttggtatttgaatgagctatattcagtttgcaggttataatgtggtgtgtgaatattgccagctttgttttggccaagttatatgttaatttcatttgaaaacctgtttaacggccggcttgttgattgcaactgagttttaaaaaattgatcctaccagtatctagtacccttcttcattttcctcttataaatagacattgacttattttaaaagtttttaaaaatctcttctttccagggtagtacttattccctggttgattttttcataccaaattatttctttatgcatggttcatgaaggcatagagattaagtgctgggattacaggcacgagccactgaatctggccatagttgaattcttaaccacagtgagctaactcctttcatggtggaaaattttaactgtcttagatgaaagttttaacttaagtatttactcctctttctttctttctttttttaaacagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456944 - DNA, 3491 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcaggtaaaaccaattttttaagtactcaacatttttttccactgtaatcgttctgtatatattgaaatttttaaaaggggagaattcagggtagtactttggtatttgaatgagctatattcagtttgcaggttataatgtggtgtgtgaatattgccagctttgttttggccaagttatatgttaatttcatttgaaaacctgtttaacggccggcttgttgattgcaactgagttttaaaaaattgatcctaccagtatctagtacccttcttcattttcctcttataaatagacattgacttattttaaaagtttttcaaattatttctttatgcatggttcatgaaggcatagagattaagtgctgggattacaggcacgagccactgaatctggccatagttgaattcttaaccacagtgagctaactcctttcatggtggaaaattttaactgtcttagatgaaagttttaacttaagtatttactcctctttctttctttctttttttaaacagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456945 - DNA, 2490 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaa

SEQ ID NO: 456946 - DNA, 2051 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtggaaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagcccggtttatcacagccactggagcacctgcacatgtatcagtggaagggctgactggctacgcttctcctgcattgg

SEQ ID NO: 456947 - DNA, 1671 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagagtatctctaacattagtttcatgccaggtattttccccgaactttgtttcccgaacttaagaaaaaaatggatattttttcttaagatgacaaccttaatatcacttgatattcaggtgatttgagatagttt

SEQ ID NO: 456948 - DNA, 982 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtatctttccctggaagatgcaccagcccattggatagcttagatgcagctgttggagggtggatctagcctgtgaggacccagtaacctggacccaatacatgacaacaaggattgaatgagtggtcgtttactgctgagtaattgctggtttcctggctacctgggccctgggtcacatggatgagagggctggaaaaaatgattatcagcacagagtccagaatcctgtgactctggcacagatatttgagtgtatgtgtagaaatgacgggtacggctcaatcgtatctggcatgctttactgtg

SEQ ID NO: 456949 - DNA, 1723 bp, Homo sapiens
actttggccggcccctagcgatctgaacccaaactaaatttcccagcaagcagcgcgccggcctgggaaaaggagcaagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtggggagccgggtggtgactgttagtgagtactacctgcggcctgtctcccagcaggagtttgacaagaacaccttggatctcaggcaacagaacggaactgcctcatcacggaagaccctctggaatcaagaactctacatccagcaggacaactcagagaggaagcggaaacaccttccagaccgacaggatgggcctgcagccaagagtgagaaagcagcccccagaagtcagcactggttgcacagggacctgcgtgtgcggtttgtggacaacatgtacaaaggaggccaatattacaacaccaagatgataattgaagatgtcctaagcccagatacctgtgtatgtcggacagatgaaggccgagtcctggaaggcctgagggaagacatgctggagaccctggttcccaaggcagagggtgaccgtgtgatggtggtgctgggcccacagactggaagggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagt

SEQ ID NO: 456950 - DNA, 484 bp, Homo sapiens
tttgttgaggatgtatcccgcaggaaccgctccccttcatccaactcaggatcgttccagtattctttgagaagggctaaagctccccagggaatggcactggggctctgtctctgcctgtaacacaacataacctggccatttcagacaccctccatctcctccccgtgccacaatgctaaagcagatatctcatcagcttcagatttcctggaattcatctttctcctaagcctacgcttgaaaatggggcccaaagttcttgaatatggccctttgtccagaacacctagctccagccaaagcgcctggtctcccttgacaggccactgggactttttctgctttaccttgaaaggagccctgctgatccccattttgaggacagggctccttacattcagggaagtgtggacaatataaggaggccttcccaatatgccctttgttcactgtgcacaaacaaagccttgtatctgaagac

SEQ ID NO: 456951 - DNA, 3275 bp, Homo sapiens
gcttattgttcttaactgtgtttctctacggtatgttacagatgagccatacgtttcttgtatcaatgtagacatgacttcagatacctctgaggacctacccagcagtctaggaccctgggccaagtgctgggactatggtactaaatccagtagatgggctgtgtagcaactctcccaggaacacactagggtacttagggaggtgcttgtggagcatgttgaagcttgagatctgagcaggaggcagtgatgtccctggtctattcagggaaagatttcagtgtgaaatggtaaatcctgtcagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtggggagccgggtggtgactgttagtgagtactacctgcggcctgtctcccagcaggagtttgacaagaacaccttggatctcaggcaacagaacggaactgcctcatcacggaagaccctctggaatcaagaactctacatccagcaggacaactcagagaggaagcggaaacaccttccagaccgacaggatgggcctgcagccaagagtgagaaagcagcccccagaagtcagcactggttgcacagggacctgcgtgtgcggtttgtggacaacatgtacaaaggaggccaatattacaacaccaagatgataattgaagatgtcctaagcccagatacctgtgtatgtcggacagatgaaggccgagtcctggaaggcctgagggaagacatgctggagaccctggttcccaaggcagagggtgaccgtgtgatggtggtgctgggcccacagactggaagggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagtacttaatagaaagatgaaatcataagtggtatgatgagctgcgagttaaggtgggaactgagttgactgaggtgggaaccatttcacttttaagccttgcttttctgctcagggtacaggacaagttaaaggactcatttgattgtgagctcactcttggaatatagatactataagcttgggcacagtggtgcatgcctgtaatcctagcactttaggaggctgaggtggatggatcgcttgagcccaggagttcaagatcagcctggccaacaaggtgaaaccctgtctctactaaaagtataaaaatacaaaaaattaccgaggtatggtggtgcacgcctataatcctagctactcaggaggctgaggcaagagaatcgcttgaacccaggaggcagaggttgctgtgagcccagattgcgccactgcactccagcccaggggacagagttagactctgtctcaaaaaaaaaaaaaaaaatctttagatgctgtggaatctgaaatactgtatctctgaacaactttctgagcaagaactctagcaactagcagcagagtatgctttcactctcagtttagagcaggaccccagagaatatgctgagcctggggtcttcctctgttgcccagactggagtgcagtggtgcaatcatagctcacagcagcattgatctcctgggctcaagcgatcttcccgtctcagcctcccaaagtgctgggattataggcactggaatgagccaccgtgcctggtctctggcttgtattttgttaatcgtagggaggatgttcccaacttctcatgtccagtagtccatttcctatgctttatgcacttcactctgtcaaggaggcctcctcctttctccaatcataataaaccagccttggtagcacctttgagaagggctaaagctccccagggaatggcactggggctctgtctctgcctgtaacacaacataacctggccatttcagacaccctccatctcctccccgtgccacaatgctaaagcagatatctcatcagcttcagatttcctggaattcatctttctcctaagcctacgcttgaaaatggggcccaaagttcttgaatatggccctttgtccagaacacctagctccagccaaagcgcctggtctcccttgacaggccactgggactttttctgctttaccttgaaaggagccctgctgatccccattttgaggacagggctccttacattcagggaagtgtggacaatataaggaggccttcccaatatgccctttgttcactgtgcacaaacaaagccttgtatctgaagac

SEQ ID NO: 456952 - DNA, 2307 bp, Homo sapiens
actttggccggcccctagcgatctgaacccaaactaaatttcccagcaagcagcgcgccggcctgggaaaaggagcaagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagtacttaatagaaagatgaaatcataagtggtatgatgagctgcgagttaaggtgggaactgagttgactgaggtgggaaccatttcacttttaagccttgcttttctgctcagggtacaggacaagttaaaggactcatttgattgtgagctcactcttggaatatagatactataagcttgggcacagtggtgcatgcctgtaatcctagcactttaggaggctgaggtggatggatcgcttgagcccaggagttcaagatcagcctggccaacaaggtgaaaccctgtctctactaaaagtataaaaatacaaaaaattaccgaggtatggtggtgcacgcctataatcctagctactcaggaggctgaggcaagagaatcgcttgaacccaggaggcagaggttgctgtgagcccagattgcgccactgcactccagcccaggggacagagttagactctgtctcaaaaaaaaaaaaaaaaatctttagatgctgtggaatctgaaatactgtatctctgaacaactttctgagcaagaactctagcaactagcagcagagtatgctttcactctcagtttagagcaggaccccagagaatatgctgagcctggggtcttcctctgttgcccagactggagtgcagtggtgcaatcatagctcacagcagcattgatctcctgggctcaagcgatcttcccgtctcagcctcccaaagtgctgggattataggcactggaatgagccaccgtgcctggtctctggcttgtattttgttaatcgtagggaggatgttcccaacttctcatgtccagtagtccatttcctatgctttatgcacttcactctgtcaaggaggcctcctcctttctccaatcataataaaccagccttggtagcacctttgagaagggctaaagctccccagggaatggcactggggctctgtctctgcctgtaacacaacataacctggccatttcagacaccctccatctcctccccgtgccacaatgctaaagcagatatctcatcagcttcagatttcctggaattcatctttctcctaagcctacgcttgaaaatggggcccaaagttcttgaatatggccctttgtccagaacacctagctccagccaaagcgcctggtctcccttgacaggccactgggactttttctgctttaccttgaaaggagccctgctgatccccattttgaggacagggctccttacattcagggaagtgtggacaatataaggaggccttcccaatatgccctttgttcactgtgcacaaacaaagccttgtatctgaagac

SEQ ID NO: 456953 - DNA, 723 bp, Homo sapiens
ggtgtgaccaagaaggaaggaattctaggcagacagaacagcacaggcgaaggcgtttcggtaggacggggcagtttggcaaatgggtacagacagagctctctgggaatctctagtccacactaggtgagcattgttgttgtgggctaggttggctgcgggagggttcctgaaggaagctgaaatggttgagaggtgggggagaggcattctactagcaaatgcatgaggggtgagaggggcactttggcaggtgggaggtggctctaggctgagacatggccttggaaggaaagggcagtgagacactgaggctctgtcctggttctcctcataacctcttgaacaggccagatgagcaaaacttccttccccagggcaacagaacggaactgcctcatcacggaagaccctctggaatcaagaactctacatccagcaggacaactcagagaggaagcggaaacaccttccagaccggtgggactctgagcatgcgggaggggtcaagaaggcagggctgtgggtaggctcgagcagccagggaaggcttccaaggcaaggcgggctcatagaaggaacggggaactgcattgtgggtgggtttcatagcataggcaaagggagggcaactggaaagtgcatctgatgaagagctaagcctggtgctggcaccttctccacagacaggatgggcctgcagccaagagtgagaaagcagcc

SEQ ID NO: 456954 - DNA, 3047 bp, Homo sapiens
actttggccggcccctagcgatctgaacccaaactaaatttcccagcaagcagcgcgccggcctgggaaaaggagcaagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtggggagccgggtggtgactgttagtgagtactacctgcggcctgtctcccagcaggagtttgacaagaacaccttggatctcaggcaacagaacggaactgcctcatcacggaagaccctctggaatcaagaactctacatccagcaggacaactcagagaggaagcggaaacaccttccagaccgacaggatgggcctgcagccaagagtgagaaagcagcccccagaagtcagcactggttgcacagggacctgcgtgtgcggtttgtggacaacatgtacaaaggaggccaatattacaacaccaagatgataattgaagatgtcctaagcccagatacctgtgtatgtcggacagatgaaggccgagtcctggaaggcctgagggaagacatgctggagaccctggttcccaaggcagagggtgaccgtgtgatggtggtgctgggcccacagactggaagggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagtacttaatagaaagatgaaatcataagtggtatgatgagctgcgagttaaggtgggaactgagttgactgaggtgggaaccatttcacttttaagccttgcttttctgctcagggtacaggacaagttaaaggactcatttgattgtgagctcactcttggaatatagatactataagcttgggcacagtggtgcatgcctgtaatcctagcactttaggaggctgaggtggatggatcgcttgagcccaggagttcaagatcagcctggccaacaaggtgaaaccctgtctctactaaaagtataaaaatacaaaaaattaccgaggtatggtggtgcacgcctataatcctagctactcaggaggctgaggcaagagaatcgcttgaacccaggaggcagaggttgctgtgagcccagattgcgccactgcactccagcccaggggacagagttagactctgtctcaaaaaaaaaaaaaaaaatctttagatgctgtggaatctgaaatactgtatctctgaacaactttctgagcaagaactctagcaactagcagcagagtatgctttcactctcagtttagagcaggaccccagagaatatgctgagcctggggtcttcctctgttgcccagactggagtgcagtggtgcaatcatagctcacagcagcattgatctcctgggctcaagcgatcttcccgtctcagcctcccaaagtgctgggattataggcactggaatgagccaccgtgcctggtctctggcttgtattttgttaatcgtagggaggatgttcccaacttctcatgtccagtagtccatttcctatgctttatgcacttcactctgtcaaggaggcctcctcctttctccaatcataataaaccagccttggtagcacctttgagaagggctaaagctccccagggaatggcactggggctctgtctctgcctgtaacacaacataacctggccatttcagacaccctccatctcctccccgtgccacaatgctaaagcagatatctcatcagcttcagatttcctggaattcatctttctcctaagcctacgcttgaaaatggggcccaaagttcttgaatatggccctttgtccagaacacctagctccagccaaagcgcctggtctcccttgacaggccactgggactttttctgctttaccttgaaaggagccctgctgatccccattttgaggacagggctccttacattcagggaagtgtggacaatataaggaggccttcccaatatgccctttgttcactgtgcacaaacaaagccttgtatctgaagac

SEQ ID NO: 456955 - DNA, 2052 bp, Homo sapiens
actttggccggcccctagcgatctgaacccaaactaaatttcccagcaagcagcgcgccggcctgggaaaaggagcaagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtggggagccgggtggtgactgttagtgagtactacctgcggcctgtctcccagcaggagtttgacaagaacaccttggatctcaggcaacagaacggaactgcctcatcacggaagaccctctggaatcaagaactctacatccagcaggacaactcagagaggaagcggaaacaccttccagaccgacaggatgggcctgcagccaagagtgagaaagcagcccccagaagtcagcactggttgcacagggacctgcgtgtgcggtttgtggacaacatgtacaaaggaggccaatatttaccaaaatttagggtataataaaaaccatttcaagtacttaatagaaagatgaaatcataagtggtatgatgagctgcgagttaaggtgggaactgagttgactgaggtgggaaccatttcacttttaagccttgcttttctgctcagggtacaggacaagttaaaggactcatttgattgtgagctcactcttggaatatagatactataagcttgggcacagtggtgcatgcctgtaatctgggattataggcactggaatgagccaccgtgcctggtctctggcttgtattttgttaatcgtagggaggatgttcccaacttctcatgtccagtagtccatttcctatgctttatgcacttcactctgtcaaggaggcctcctcctttctccaatcataataaaccagccttggtagcacctttgagaagggctaaagctccccagggaatggcactggggctctgtctctgcctgtaacacaacataacctggccatttcagacaccctccatctcctccccgtgccacaatgctaaagcagatatctcatcagcttcagatttcctggaattcatctttctcctaagcctacgcttgaaaatggggcccaaagttcttgaatatggccctttgtccagaacacctagctccagccaaagcgcctggtctcccttgacaggccactgggactttttctgctttaccttgaaaggagccctgctgatccccattttgaggacagggctccttacattcagggaagtgtggacaatataaggaggccttcccaatatgccctttgttcactgtgcacaaacaaagccttgtatctgaagac

SEQ ID NO: 456956 - DNA, 1783 bp, Homo sapiens
cggtacccgacatttccacgagtcagcctgagggaagacatgctggagaccctggttcccaaggcagagggtgaccgtgtgatggtggtgctgggcccacagactggaagggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagtacttaatagaaagatgaaatcataagtggtatgatgagctgcgagttaaggtgggaactgagttgactgaggtgggaaccatttcacttttaagccttgcttttctgctcagggtacaggacaagttaaaggactcatttgattgtgagctcactcttggaatatagatactataagcttgggcacagtggtgcatgcctgtaatcctagcactttaggaggctgaggtggatggatcgcttgagcccaggagttcaagatcagcctggccaacaaggtgaaaccctgtctctactaaaagtataaaaatacaaaaaattaccgaggtatggtggtgcacgcctataatcctagctactcaggaggctgaggcaagagaatcgcttgaacccaggaggcagaggttgctgtgagcccagattgcgccactgcactccagcccaggggacagagttagactctgtctcaaaaaaaaaaaaaaaaatctttagatgctgtggaatctgaaatactgtatctctgaacaactttctgagcaagaactctagcaactagcagcagagtatgctttcactctcagtttagagcaggaccccagagaatatgctgagcctggggtcttcctctgttgcccagactggagtgcagtggtgcaatcatagctcacagcagcattgatctcctgggctcaagcgatcttcccgtctcagcctcccaaagtgctgggattataggcactggaatgagccaccgtgcctggtctctggcttgtattttgttaatcgtagggaggatgttcccaacttctcatgtccagtagtccatttcctatgctttatgcacttcactctgtcaaggaggcctcctcctttctccaatcataataaaccagccttggtagcacctttgagaagggctaaagctccccagggaatggcactggggctctgtctctgcctgtaacacaacataacctggccatttcagacaccctccatctcctccccgtgccacaatgctaaagcagatatctcatcagcttcagatttcctggaattcatctttctcctaagcctacgcttgaaaatggggcccaaagttcttgaatatggccctttgtccagaacacctagctccagccaaagcgcctggtctcccttgacaggccactgggactttttctgctttaccttgaaaggagccctgctgatccccattttgaggacagggctccttacattcagggaagtgtggacaatataaggaggccttcccaatatgccctttgttcactgtgcacaaacaaagccttgtatctgaagac

SEQ ID NO: 456957 - DNA, 398 bp, Homo sapiens
tgtgatgtctttgtctggttttggtattgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtgg

SEQ ID NO: 456958 - DNA, 192 bp, Homo sapiens
tgtgatacacataagtgaaatgcagaactcttaattatagaccttagtgaattttcacaaagtgaacacaccagtgtaaccatcacccagatcaagatacaggttaaatatcccttatccaaaatgcttgggaccagaagtgtttcagatttcagacctttggatttggagtatttgcatatacataatgag

SEQ ID NO: 456959 - DNA, 679 bp, Homo sapiens
ggacgcgtgggtcgacccacgcgtcgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456960 - DNA, 258 bp, Homo sapiens
aaattgaggtccgggtggatattgaggtctgatggggggaaggagtaaacaatagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456961 - DNA, 472 bp, Homo sapiens
ggtgatccactagattcagagctgctggcatgctagcttggtacaggacgtcgttatacaacaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacagaatcagctgaaccaagccagttgaaagttccgttgaagccctcggggagtcctctag

SEQ ID NO: 456962 - DNA, 726 bp, Homo sapiens
tcacatctgcatcagatttattttttaaaggaatggattttgtgtggattatggcatggaaagtggctgagaaattctgtagcagggtaacaaaattatcttggtccaggagtcctgtagtggagaagataaaagtcaatgcttaactcataggttaacctcagcatgcttttgatttggtcaagcaatcaaagtactggtgaagaattgaagattggaagtgacacattttttgctcagggaagtaatggagaaagaaaaatcttcctggaggtagatcttcagtttggattagtctgaacatgatgaaacctgtagaaaccttcatttctcaagacaaagctcaaattcaaggttgtgaggaatgcagtcaccacttttgttaggggcagttgtgacagtgagtgactgcaaaaactgagaatgcgaagcctctattgtaaaaagaatgtgcaagtgccatagaagtcactgcaaggattgggtgctggagcagtgccggacctgccatcgtcaccagagtgcagcagattcaccagaaggagaatctccactcttgtcgtcactaacagcacttgactttgtcccattcataaaagatcttggaaggaattaaaggtgcttggtggttcctcattccaacaacaccttacttggcctgcccgtggaacatgcgttagtctttggacaggacaactcgagtcacagaccacaagagaaaagaat

SEQ ID NO: 456963 - DNA, 412 bp, Homo sapiens
ttaacttttgctcaattttcagagaaatggaatgctcgcatcactgatctacgtaaacaagttgaagaattgtttgaaaggaaatatgctcaagcctcttctttcctcacttcctgttctctgtcctcattattccaccagtctattgtcatatttttccccttcccagcctgcccagccaggatatgcggcaggaggttcatttttgaaagtataagaagggccgccgggaatgagtgtctcacggggacagagtgtgcgtttgggaagatgagacggttgtggagatgaatggtggggatggttacacaacaacgtgaatatgcttaaagccacgttcacggaacacgttcaaatgactaaaatggtaactttctggtatggatattttgccacaataaaaaaaaatgct

SEQ ID NO: 456964 - DNA, 4214 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456965 - DNA, 3517 bp, Homo sapiens
ttgctgcctgctgagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456966 - DNA, 5693 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttagctaggcacaatgtctaacgcctgtaatcccagcattttgggaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaaccttgcatcagccatttgttagccaggtcactctgttctttgtctgtaaatgagattgatcgttgttcccactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccaccgtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcacggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456967 - DNA, 3770 bp, Homo sapiens
ttcttcaagacctagtaatagttctctggggtttcatcatttgtttcagcttagatttgttgacagcggtttcctggagtgctgtcttgagaacgattctgaggaggctcagcaagaaagagtgtttcagttgattgggtgtgtctgtcatggagaaggaagtaaggagtgggcagtgctagcaaaattcccggggcacttctgtccattatctcaatacctggggttgacatttcctgtctcagatcaggagtcctgactaccctgcctctgaccactcgaactgagtgctgcttagctgtatcgtagacaccgcctgtttgtgaacagacaccctgcttcttgatgataacacaaaggccagcagggtccactgctgtgtggaatggccttcggtcatttctgcccagagcatagaggtcattttcactaataacataactctccttttgattgaaagtgttaaaatgttcctcctaaaagcacttattttttaggctcgttcttcagatttgccccatatcctaagcaaaatgccttcaatatgaagtggatattgcttgaccgtagggagcttgtccatactgtactcgagaatgtagacacaaagaaagaatgtctgtgtcaaatgttatcctccgcaacttaacgttctcttgcactttcagctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456968 - DNA, 2776 bp, Homo sapiens
cgtggggaacctggcgctaaaccattcgtagacgacacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456969 - DNA, 2768 bp, Homo sapiens
aggataaaacaacgccaaagcgaacgacacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456970 - DNA, 3244 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456971 - DNA, 4314 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttggtaagtaaaagccagtatttatgtctttaataacatatcaacaaagggccatgtctgaatgaagtatagaagttcgggaccagccgggtgcagtggctcacgcctgtaatcgcagcactttgggaggccaaggcgggcggatcgggaggtcaggagatcgagaccatcctggctaacacgatgaaaccccgtctctactaaaaatacaggaaaattagccgggcgtggtggcgggcgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaaccttgcatcagccatttgttagccaggtcactctgttctttgtctgtaaatgagattgatcgttgttcccactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccaccgtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcacggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456972 - DNA, 2287 bp, Homo sapiens
gttttgctctctttcttctgggtgaattggatttgcaggttatgctgttgagtgatgacgcatagctgcttttgctccatttcccccagatgacttggtaaattctccgtgaatgactctgctacataacctagataacctaacgtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456973 - DNA, 2062 bp, Homo sapiens
gtagcgagcagtatacacagcttcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456974 - DNA, 4582 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagacggggggggcgcgcgctcgaaataataaccgccagcgcggggaggagcacacccatccgaacggccagccccccccttttatttgtaagaaggggggggcgcaccatgaagagggaagtcaaatataattagaaacgagagcgggggcggttcgtataacacacacaagtcggacagaggagacaaatccgccgacgggggcattacgaggagcgagaacacacacacgagggggggggggaaaaaaaaagggaaacacacacaccaaaa

SEQ ID NO: 456975 - DNA, 1353 bp, Homo sapiens
ggaacaacacatccttacattatttaaaccaatctgcttcattttcagagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456976 - DNA, 1315 bp, Homo sapiens
gaaaacagccaggaggatgatcacagagtgactgacggccgtttgacacaagaatcagccgatccacgccagtaggaagtcccgggcacatatgaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456977 - DNA, 1554 bp, Homo sapiens
gcctcttctaccacatagggctcagggctgataaagccccctccctacctttctcaggccagacacaaggtcagccatgagaaaacagaaaaacaagcagaggagagtctgtagagataagttgggagggttcaggaggagaatttgggatttgcttgttccgctgcagcggatcaagcaagaaccagaccccacgtggtagacctcttccctcctaggagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456978 - DNA, 3445 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactattgtcctttagcagaaccccttgaggttacggggggttgtttttttccccaatccaaggggaaagaaaatttttgccctaactttgttcctccaacg

SEQ ID NO: 456979 - DNA, 4832 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttagctaggcacaatgtctaacgcctgtaatcccagcattttgggaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaaccttgcatcagccatttgttagccaggtcactctgttctttgtctgtaaatgagattgatcgttgttcccactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccaccgtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcacggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccgtgagtattttgtgaagtgttttgtttttgttttttcctggggtctgacgtgtgtgcgtgtgagtgtgtatacatgcttaacgtatatcacgttacttcacctatgtcagtaaccaggccaaatacttgttttagccctcagtaaaaacaccaggcacttcctagttgtaaaattattcaagcttcttaacttcctatcctcgatgcacttaatcataaaatggtaataatagcaccgattttgggggagtcgttccagtagatggaaagcatctggaacaggtgtcagcaagctcctgccgacgtgtatgcataaagttttattgaaaccaccatcgtgtccatttgtttatggcagaactgagagatggcagcagcaagtgtgtgcctgcaaaacctaaaatatttactaattggctctgcaagaaaagagtttgcatccccctaacctagaacagtgtctagcctctagtatgtgtttagcctacagtatgtgctcagcgaatacaatctatatttattactgcttttatgactgttataattactgtgcttggatttcgttacaaagtaagtcacaatgtgcctgcttctgttagtatttcagcacagtgcctggcacacatggggctctcaaatattgctgagcgagtgaacaaatgtcctttcaattccttaacgttgatgtcattttcaatagtattttgagccaaacttaattttgcgagtgtgttttgttttcttaactttattattaaaaatgtataaaagtgaggccaggcgtggtggctcacgcctgtaatcccagcagtttgggaggctgaggcaggcggatcagttgaggttgggagttggagaccagcccgtccaacatggtgaaagcctgtctctactaaaaatacaaaaatcagctgggtgtggtggcgcgtgcctgtaatcccagctactcaggaggctgaggcaggagagttgcttgaatcctagaggtggaggttgcagtgagctgagatcgtgccattgcactccagcctgggcaacaagagcaaaactctgtcccaataaataaataaataaaatgttctcttttgttcctgttcttgtgcggtagtgtggtatagagttttatggtaattactg

SEQ ID NO: 456980 - DNA, 4184 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttagctaggcacaatgtctaacgcctgtaatcccagcattttgggaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaaccttgcatcagccatttgttagccaggtcactctgttctttgtctgtaaatgagattgatcgttgttcccactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccaccgtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcacggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccagctggttgatcagagtgagtcagaaggccccgtgatacaaggtgagcgaggcaggggagggcccggagctactcctgcctgcacagtggcacacatggcgtgcctgcgtgtggcttcggctctcagtcacctgccctgaggggactcagttacacagcacacacatgcttctctgtggttttcactcctgggtttgacagctgatcaaaacataaattcaagctgtgggtcctgattgagaactgggggctgcagaccatttgcaccccctatcccagctcaggcctaacatcaggaaccccaggattaatgggtaggatgaaatggcagagcaagagggccgtcactttaacctgactctgccatccatttctaatgtctgccataagtcagtgagcaaaatgttcttcagtagaaatgtacagattgtgctcttaaaaaattccttaaaaaacaagtggaatggcctggtgctgtgtgagtcattg

SEQ ID NO: 456981 - DNA, 2665 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttgcctcccaaagtgctgggattacaggtgtgagccactgtgcccacctagaatgtttacagatgcccttcgctgacaaccgcatcacccgttc

SEQ ID NO: 456982 - DNA, 2029 bp, Homo sapiens
  misc_feature (2015)..(2015): n is a, c, g, or t
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttgcatgggatcctntagagtcacctcat

SEQ ID NO: 456983 - DNA, 2415 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggtaagtctatttgaaaccttcttactgccacgcagggtgccttcatgggagtaggagggagcagagtgggatactgagcgttggagtatccctgtcattggcaacgtgtgggtttttcgggattgaatggcgtcatttcgcccatgttctgtttcgtgtacgcggctgttttgcaggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagtaaggaaactggatgaagtgggattagcatgagttgattgtgtttgacactgggagatgggtatgtgggtttgtgtttgtggcagggctgaattagctctggagtcagaaaaactgctttttaagctgcactcttgtatatgtttaaaacttctggccaggtgcgatctcagctcacaatcactagtgaattcccagcactttgggaggccaaagcaggtggattacctgaggtcagaagttcaagaccaacctggccaacatgatgaaacccatctctactaaaagtacaaaaattagctgggcgtggtggcacgtgcctgtaatcccagctacttgggagactgaggcaggagaatcacttgaacccagcaggcagaggttgcaatgagccaagatcgtgccactgcactccagcctgggcagcaagagcaaaactccatctcaaaaacaaaaa

SEQ ID NO: 456984 - DNA, 1613 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccaggttaacctcagcatgcttttgatttggtcaagcaatcaaagtactggtgaagaattgaagattggaagtgacacattttttgctcagggaagtaatggagaaagaaaaatcttcctggaggtagatcttcagtttggattagtctgaacatgatgaaacctgtagaaaccttcatttctcaagacaaagctcaaattcaaggttgtgaggaatgcagtcaccacttttgttaggggcagttgtgacagtgagtgactgcaaaaactgagaatgcgaagcctctattgtaaaaagaatgtgcaagtgccatagaagtcactgcaaggattgggtgctggagcagtgccggacctgccatcgtcaccagagtgcagcagattcaccagaaggagaatctccactcttgtcgtcactaacagcacttgactttgtcccattcataaaagatcttggaaggaattaaaggtgcttggtggttcctcattccaacaacaccttacttggcctgcccgtggaacatgcgttagtctttggacaggacaactcgagtcacagaccacaagagaaaagaat

SEQ ID NO: 456985 - DNA, 1023 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcaggtggtgtgggtaccgagctgagt

SEQ ID NO: 456986 - DNA, 1582 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaaggtaagatgataatctgtagaaatagtttcagtgtcttccctgagaagaggttaatttgatgaagaagggccttttgtttaccttatgacttatttctattgacaatgaaggcattaatatttagattcacttagtgaacaaatattagtataagcatcagatgtgcaaaattgggtctaacaagaacactgtccttggggccttcatacaaagaaaaatgcactgaaggccgggcgcggcagctcacgcctgtaatcgcagcactttgggaggccaaggcaggtggatcacttgaggtcaggagttcaagactagcctggccaacatgatgaagccccatctctagtaaaaatacaaaaattagctggaagcggtggtgcgagcctgtagtcccagctactcgggaggctgaggttggagaatcacttgaaccctagaggcggaggttgcagtgagccgagatcgtgccactgcactccagcctgggcaacagagcgagactccatctcaaaataattacccgcggctcacctccacaccttgtcgccgccttgccccaagcgactttagacttgaccaagttatgctcccggccccttct

SEQ ID NO: 456987 - DNA, 231 bp, Homo sapiens
caaaagtgcactcttctatatctaccagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456988 - DNA, 425 bp, Homo sapiens
aatgcccataccctgtagtgtgtaaatgcccataccctgtagtgtgaagttttctgttgttagaaataagtgttaggaatcaagtatgaaatttgtgtgtgtactaggtgtatacagattggtgcagttaatcatgctcacgactactaaggtgaacaaatgtttcaagttgggttcctgggtgtgccctaaaatacttctccttcagctctcacagcaccttgtggacatgagtgaaggtcagtcagtgtgccaaatagattttgtgtggattatggcatggaaagtggctgagaaattctgtagcagggtaacaaaattatcttggtccaggagtcctgtagtggagaagataaaagtcaatgcttaactcataggttaacctcagcatgcttttgatttggtcaagcaatcaaagtactggt

SEQ ID NO: 456989 - DNA, 336 bp, Homo sapiens
ctttgcagtcccccaaaagaccacgaagtcctgggagtaattcaaaggttcctgaaattgaggtcaccgtggaaggtaagggccagtcctcggtatgtttctgttcattctctagtttactaattatgtcagttcactagctatgtgtttatacaggtttatacagatgacgttaaccaaactagcttttaactgtgaacagctgcctgtgataaagctaaatttctgaatgcttctaattgaaaatttttaaatccttaatagaaaacagataacatggatcacatcataaacttcccccaagaaaagtcctaaaatgcttttcctttatcataa

SEQ ID NO: 456990 - DNA, 202 bp, Homo sapiens
caacatcgtgagataccatctctttaccataaaaaaaaaaaaaagcagtatttaagttttgggttttctctgaactgtttcagatgatgataatgaaagactctcgaaagttgaaaaagctagacagctaagagaacaagtgaatgacctctttagtcggaaatttggtaagttttgcatttgcaaagtacagttgctataa

SEQ ID NO: 456991 - DNA, 3573 bp, Homo sapiens
catgaatacggtttgagtgtacgaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456992 - DNA, 3521 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456993 - DNA, 3484 bp, Homo sapiens
ggtcggactatagtacggcgcagtgtgctgaactcgttttacagacaccctgcttcttgatgataacacaaaggccagcagggtccactgctgtgtggaatggccttcggtcatttctgcccagagcatagaggtcattttcactaataacataactctccttttgattgaaagtgttaaaatgttcctcctaaaagcacttattttttaggctcgttcttcagatttgccccatatcctaagcaaaatgccttcaatatgaagtggatattgcttgaccgtagggagcttgtccatactgtactcgagaatgtagacacaaagaaagaatgtctgtgtcaaatgttatcctccgcaacttaacgttctcttgcactttcagctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456994 - DNA, 2775 bp, Homo sapiens
  misc_feature (13)..(13): n is a, c, g, or t
  misc_feature (20)..(20): n is a, c, g, or t
  misc_feature (31)..(31): n is a, c, g, or t
ctggctggctctngaggatncactaaagccnagccacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456995 - DNA, 3300 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456996 - DNA, 4404 bp, Homo sapiens
  misc_feature (4265)..(4265): n is a, c, g, or t
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaaaaaaaaaagctttgatgcaagaggtggggctggaaagggacatgtggngttggcattgcttataaataggccaggaaaggagattaggcccaagcactgttaaagccatggcaagcaagtgggggcggctctaataattgcctttgcctcccatcctgagagaggcctggtgggctaggtattatct

SEQ ID NO: 456997 - DNA, 3634 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgactttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtacgcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctgg

SEQ ID NO: 456998 - DNA, 904 bp, Homo sapiens
  misc_feature (119)..(119): n is a, c, g, or t
ggacgctcactccagactggggaatggagcatgacagtctttgaatatcgaacacgcaaggttgggagactacctatgtagatatgcaccctatgacatggtggtcctgatcaagaatntggtgtggacgttggccctgtttgctttttataaaccaaactctatctgaaatcccaacaaaaaaaaatttaactccatatgtgttcctctggttctaatcttgtcaaccagtgtggccagtgtggagagagactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 456999 - DNA, 4030 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttagctaggcacaatgtctaacgcctgtaatcccagcattttgggaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaaccttgcatcagccatttgttagccaggtcactctgttctttgtctgtaaatgagattgatcgttgttcccactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccaccgtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcacggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccgtgagtattttgtgaagtgttttgtttttgttttttcctggggtctgacgtgtgtgcgtgtgagtgtgtatacatgcttaacgtatatcacgttacttcacctatgtcagtaaccaggccaaatacttgttttagccctcagtaaaaacaccaggcacttcctagttgtaaaattattcaagcttcttaacttcctatcctcgatgcacttaatcataaaatggtaataatagcaccgattttgggggagtcgttccagtagatggaaagcatctggaacaggtgtcagcaagctcctgccgactgtcatctcagcggggatcctaaagagtcaa

SEQ ID NO: 457000 - DNA, 2314 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacagaatcagctgaaccaagccagttgaaagttccgttgaagccctcggggagtcctctag

SEQ ID NO: 457001 - DNA, 2239 bp, Homo sapiens
atagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagtaaggaaactggatgaagtgggattagcatgagttgattgtgtttgacactgggagatgggtatgtgggtttgtgtttgtggcagggctgaattagctctggagtcagaaaaactgctttttaagctgcactcttgtatatgtttaaaacttctggccaggtgcgatctcagctcacaatcactagtgaattcccagcactttgggaggccaaagcaggtggattacctgaggtcagaagttcaagaccaacctggccaacatgatgaaacccatctctactaaaagtacaaaaattagctgggcgtggtggcacgtgcctgtaatcccagctacttgggagactgaggcaggagaatcacttgaacccagcaggcagaggttgcaatgagccaagatcgtgccactgcactccagcctgggcagcaagagcaaaactccatctcaaaaacaaaaa

SEQ ID NO: 457002 - DNA, 1124 bp, Homo sapiens
  misc_feature (14)..(14): n is a, c, g, or t
  misc_feature (18)..(18): n is a, c, g, or t
ctgggattacaggngtgngccacacctggctaatttttgtatttttagtagagacaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 457003 - DNA, 5043 bp, Homo sapiens
ggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcctccagcccctgcacagatcaagctgatgccacgtggcccaagttccaaccctaagtcacgttcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 457004 - DNA, 5119 bp, Homo sapiens
ggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactgaaaaaaaaaaaagggggcgtctaagttccctcggggccagttaccgaccagttctgtcaaggggcctatgggagcgataaagcagcacgcgcgtacagcgacggaacgccggattggacgcccctgggggccagacacccg

SEQ ID NO: 457005 - DNA, 4443 bp, Homo sapiens
ggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 457006 - DNA, 3716 bp, Homo sapiens
ggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctggacaccagttcctggccatcatcgtgggaataacccccagatgcattccctgctgctcaggtcaagatgccggacgcttccacgaggccagcagtgggggtcggtggacaagcggatagcgcttgggggtatccacggatgatggcggacgggggcaactaggtgcaggaggaacagaaaagacggccggggaaaggcctggcagctccccaaaaggggcgcagagaacgggagaagaaacggaggcagcgacaggtgagacgcggctaagcgggggagcaagaaggaatcaagaagggggcagcgcaccatatggcacacaagcgaggg

SEQ ID NO: 457007 - DNA, 303 bp, Homo sapiens
agcctgcttccttccagacagcagcctccccgactaccactacatcatggagaacctcttcctgtgagtccccgcccgcggcgagcagcctcgggccagctctgatgcctccctggccacaggggcaccaggctgcaaggattgcattgtggccctaggaagcctgcctggcaccagggaagggcgtggtggccacagaccttgatctgagtccctgctggccctgaggctcacagtggccttccctctgggccaccctgttctcctccccgtcctcctcctcctcctcttcctcctccttcc

SEQ ID NO: 457008 - DNA, 4979 bp, Homo sapiens
ggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 457009 - DNA, 4976 bp, Homo sapiens
ggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtaggtgtgcaggggaccatgggcagagagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 457010 - DNA, 3279 bp, Homo sapiens
gcccgcgtggcgtcggtggcctccccctgcgcttcttgccttcctcggctgagagttcgtgagtgtggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 457011 - DNA, 2044 bp, Homo sapiens
ggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 457012 - DNA, 342 bp, Homo sapiens
tccccctcgcccaggccactgcccagatatattcttctccttgggcaagaagttctgtgcatgcaggtcaaatctgaaagggacatttctttctttaatgagtgtcagggatgggggatgtggctgatgatataaggggccctccaatcagactttctaatctaactgaaaagataattacaatgttgatgctaaaaaagaaggttctggcaaaatagaacttctgaagcatcataaatcagatgactaatatttgtgatccctttttaaattttcatgtgaagaagaataggggatgtaactgaagaaatgaactaaaagttcttctatgtattgataacc

SEQ ID NO: 457013 - DNA, 1376 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcagcctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 457014 - DNA, 1028 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaagtaaaatagaacttgaatgtaaaaaat

SEQ ID NO: 457015 - DNA, 1873 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 457016 - DNA, 1260 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 457017 - DNA, 5913 bp, Homo sapiens
  misc_feature (3102)..(3102): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457018 - DNA, 6079 bp, Homo sapiens
  misc_feature (3102)..(3102): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaaggtatgggggcctggcaggggcagggattgaggggctggccaggggctggcaggctgatgctggcacctccagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccacaacccacgcgctcacggtttgtgggcgcggctggagtggtaaaaggctcagtaaaatcctgcgaagaaaaatacttctgaggtaataaataggattatcccgtatcgaaggcctttttggacgggtggtgtgtgatgtccttggtatgtgctttcatcgtgttacatcgcgccataacccactacaacccacgcgctccacaacccacgcgcccaaaacccatcgcgcccacaactcacgcgcccacaacccacgcgcccacaacccacggaccca

SEQ ID NO: 457019 - DNA, 3932 bp, Homo sapiens
  misc_feature (3102)..(3102): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgaggtaccgccacactccgcaagttccctggccagcccctgggtgctccctgcacagtgggaggggtctggggcc

SEQ ID NO: 457020 - DNA, 5630 bp, Homo sapiens
  misc_feature (2819)..(2819): n is a, c, g, or t
ctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggtgagccgcagccccgtcccgccctgccggaggccccagtaccagcttcgaggcccacctgagcctgctgccctgacccgtggccccagctgagcacgcaggcttcctggggttctcccagggtcggcggcagagccctccctccagggcccattgtgttcctgcattcccccatggagcacacgccagacctgaggggtgggacggacacccccaggcatggccggctgtctcctctccctgccttgggaggccttgctgggctctagctgtcctccagcactttgggccctgggcccccagaggcagtcagtacctgggtggagctcagagtccccacctgtgctcttcacaaaaaccaccagcagatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457021 - DNA, 6335 bp, Homo sapiens
  misc_feature (3524)..(3524): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatggtgagggcgggacctgcgggcatgccaggggcacgcctggcgaggcgggggcggggctggcgggacggagacggggctgacgaggcaggggcggggctggcggggcgggggcggggctgcgggccgtagcggactgcgctctgctccgagtcctgcccctgctaggtttgacccaggctgaggtcctgggcgggaagggcgtgacacggcctgacaccctccccagcagtctcccagttcccgcgccctccccggttccaccctccttcgctcattcatccctgtcccagcctcaaggggcttcgtctctcctggggaaggggctgttcagagctgggatttcagaccccttcggctgggagttcctcccgcggcctccaagggcggccagggcacgtcctgaggccgccctcccatcccagcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457022 - DNA, 5970 bp, Homo sapiens
  misc_feature (3159)..(3159): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatgagatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457023 - DNA, 5264 bp, Homo sapiens
  misc_feature (2453)..(2453): n is a, c, g, or t
ctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatgagatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457024 - DNA, 6281 bp, Homo sapiens
  misc_feature (3470)..(3470): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatggtgagggcgggacctgcgggcatgccaggggcacgcctggcgaggcgggggcggggctggcgggacggagacggggctgacgaggcaggggcggggctggcggggcgggggcggggctgcgggccgtagcggactgcgctctgctccgagtcctgcccctgctaggtttgacccaggctgaggtcctgggcgggaagggcgtgacacggcctgacaccctccccagcagtctcccagttcccgcgccctccccggttccaccctccttcgctcattcatccctgtcccagcctcaaggggcttcgtctctcctggggaaggggctgttcagagctgggatttcagaccccttcggctgggagttcctcccgcggcctccaagggcggccagggcacgtcctgaggccgccctcccatcccagcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagtgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457025 - DNA, 2490 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggtgagccgcagccccgtcccgccctgccggaggccccagtaccagcttcgaggcccacctgagcctgctgccctgacccgtggccccagctgagcacgcaggcttcctggggttctcccagggtcggcggcagagccctccctccagggcccattgtgttcctgcattcccccatggagcacacgccagacctgaggggtgggacggacacccccaggcatggccggctgtctcctctccctgccttgggaggccttgctgggctctagctgtcctccagcactttgggccctgggcccccagaggcagtcagtacctgggtggagctcagagtccccacctgtgctcttcacaaaaaccaccagcagatgagacccacgtgcgtccctctgggcgcctcaggccccaggatccaccatcaaggtttgcttgcctgtggaggtcgcctctccccaggggagcccccaagggcggtcgggatggtgggtttggcatccccaggcactgcctatccctttcccacactcgcttctggtgtggctggtggctggatgcccagagccgggtatcgggttgaagggtccaggtagtgccagcaggcgtcttctcttctccaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 457026 - DNA, 2296 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggtgagccgcagccccgtcccgccctgccggaggccccagtaccagcttcgaggcccacctgagcctgctgccctgacccgtggccccagctgagcacgcaggcttcctggggttctcccagggtcggcggcagagccctccctccagggcccattgtgttcctgcattcccccatggagcacacgccagacctgaggggtgggacggacacccccaggcatggccggctgtctcctctccctgccttgggaggccttgctgggctctagctgtcctccagcactttgggccctgggcccccagaggcagtcagtacctgggtggagctcagagtccccacctgtgctcttcacaaaaaccaccagcagatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 457027 - DNA, 1530 bp, Homo sapiens
  misc_feature (1512)..(1512): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgaccacgtactggccaagcantggggggatccatctaga

SEQ ID NO: 457028 - DNA, 461 bp, Homo sapiens
tgctttggagggctcacatgtccctatggcccacagggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457029 - DNA, 1167 bp, Homo sapiens
ctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 457030 - DNA, 5983 bp, Homo sapiens
  misc_feature (3102)..(3102): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaaggtatgggggcctggcaggggcagggattgaggggctggccaggggctggcaggctgatgctggcacctccagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactgcttaacgcctgcgggtatacgcccccttgggccaccttagtggcgcgccg

SEQ ID NO: 457031 - DNA, 3768 bp, Homo sapiens
  misc_feature (3102)..(3102): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagccccccaacagaccataccactgagacagcccaaggtatgggggcctggcaggggcagggattgaggggctggccaggggctggcaggctgatgctggcacctccagggcactacatggtggtggacacaagcccagacgcactaccccggggccagacggcctccctgacctccaaggagcacaggctgcaggtctcaggatatgctgaggcctgggcgttccctgccctgtgctgactctgttgctctgtgaataaacaccctggcccatgagggcagcccaaaaaaacag

SEQ ID NO: 457032 - DNA, 2163 bp, Homo sapiens
  misc_feature (1888)..(1888): n is a, c, g, or t
  misc_feature (1894)..(1894): n is a, c, g, or t
  misc_feature (1901)..(1901): n is a, c, g, or t
  misc_feature (1911)..(1911): n is a, c, g, or t
  misc_feature (1954)..(1954): n is a, c, g, or t
  misc_feature (2033)..(2033): n is a, c, g, or t
  misc_feature (2042)..(2042): n is a, c, g, or t
  misc_feature (2054)..(2055): n is a, c, g, or t
  misc_feature (2063)..(2063): n is a, c, g, or t
  misc_feature (2066)..(2066): n is a, c, g, or t
  misc_feature (2068)..(2068): n is a, c, g, or t
  misc_feature (2074)..(2074): n is a, c, g, or t
  misc_feature (2078)..(2078): n is a, c, g, or t
  misc_feature (2087)..(2087): n is a, c, g, or t
  misc_feature (2106)..(2106): n is a, c, g, or t
  misc_feature (2108)..(2108): n is a, c, g, or t
  misc_feature (2116)..(2116): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacaaaaaaaaaaaaaatnttctgntcctttntttttttttntttttaacttcctgcctatacacacgcagccatcagcccacanagacatgactaccaacgcgggccccttgacccatactggcctcagcacctaagactggacaactttgtacctaatgccngcccacctngcatatactggnnggcctctnctntngcacangggncttagtcgngaccacatggctgttgcangntctgctgnggttgcccattgggacctggcggcgacttgtcccgtgctgcttgtct

SEQ ID NO: 457033 - DNA, 5629 bp, Homo sapiens
  misc_feature (2818)..(2818): n is a, c, g, or t
ctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatggtgagggcgggacctgcgggcatgccaggggcacgcctggcgaggcgggggcggggctggcgggacggagacggggctgacgaggcaggggcggggctggcggggcgggggcggggctgcgggccgtagcggactgcgctctgctccgagtcctgcccctgctaggtttgacccaggctgaggtcctgggcgggaagggcgtgacacggcctgacaccctccccagcagtctcccagttcccgcgccctccccggttccaccctccttcgctcattcatccctgtcccagcctcaaggggcttcgtctctcctggggaaggggctgttcagagctgggatttcagaccccttcggctgggagttcctcccgcggcctccaagggcggccagggcacgtcctgaggccgccctcccatcccagcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457034 - DNA, 6530 bp, Homo sapiens
  misc_feature (3719)..(3719): n is a, c, g, or t
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggtgagccgcagccccgtcccgccctgccggaggccccagtaccagcttcgaggcccacctgagcctgctgccctgacccgtggccccagctgagcacgcaggcttcctggggttctcccagggtcggcggcagagccctccctccagggcccattgtgttcctgcattcccccatggagcacacgccagacctgaggggtgggacggacacccccaggcatggccggctgtctcctctccctgccttgggaggccttgctgggctctagctgtcctccagcactttgggccctgggcccccagaggcagtcagtacctgggtggagctcagagtccccacctgtgctcttcacaaaaaccaccagcagatgagacccacgtgcgtccctctgggcgcctcaggccccaggatccaccatcaaggtttgcttgcctgtggaggtcgcctctccccaggggagcccccaagggcggtcgggatggtgggtttggcatccccaggcactgcctatccctttcccacactcgcttctggtgtggctggtggctggatgcccagagccgggtatcgggttgaagggtccaggtagtgccagcaggcgtcttctcttctccaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctgaactctgtccttggcttcctgcaccctgcgtcaccacctccgggggcccccagaccctaactaaagcagggaccctgtatctggcaccggacagcacctggctgctcaggacgaatgaatgacggcgtgatcctccacagcctgacttaaaggcaccctgtgtggccgcactgctccctctggcccaaccatgcctctgtccagccacctgctgcccgccttggtcctgttcctgggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggtgaggccagggcaagtctctgtgcgcccctgtcccaataccctccttgctccctgccccgtctcctgacctctcacctgcgccaggctggtacatggccgttggaacccaccgagggaaagaggcatccaccgcagccctgcgctcgccaaccctgcgagaggcagcctcctcttgcaagctgaggctctggtaccacgcggcctctggaggtgcaccctggacccccaaggctcgtggggggtgcccaaggggagggcgggtgggcagctggggacaagcagggccgcagctgccctgggacccctgacattgcagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgngctggtggtcctgagcgcccctcctggccacgccgtgaccacagccggaacagtgcacaggctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagctggagtttgtcggtttggtggacttggatggccctgaccagcagggagctggggtggacaacgtgaccctgagggactgtagccccacagtgaccaccgagagagacagaggttcctgctgcccatcctcactcccacctgggtgctccccttacactcctccagggaccccggagcttccaccttctcagggctctggagggggaggggagaaggtgtgtgacgccacctggccccacccccagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457035 - DNA, 1944 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacaaaaaaaaaaaaaaaaaaccacgagcaaatgatattaacacatgacaatcactacaagaacaaaaaagaggg

SEQ ID NO: 457036 - DNA, 1930 bp, Homo sapiens
tccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaacctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatgagatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 457037 - DNA, 1053 bp, Homo sapiens
ctgccctgcacccgccaggtggtgtttgaggcagtggccgcaggcgtggcacactcctacgtggctctggatgatctgctcctccaggacgggccctgccctcagccaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagcccaaaaaaacag

SEQ ID NO: 457038 - DNA, 5074 bp, Homo sapiens
ggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactaaaaaaaaa

SEQ ID NO: 457039 - DNA, 4954 bp, Homo sapiens
ggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactaaaaaaaaa

SEQ ID NO: 457040 - DNA, 1941 bp, Homo sapiens
gggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactaaaaaaaaa

SEQ ID NO: 457041 - DNA, 3597 bp, Homo sapiens
tgacaacaggtgaacaccacaacgactgaatagaatagttccctaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactaaaaaaaaa

SEQ ID NO: 457042 - DNA, 602 bp, Homo sapiens
tgaacggttaaaagcacagtctatggaacgctaatggagtcagcccctaaagctgtttgctttttcaggctttggattacatgcttttaatttgattttagaatctggacactttgaatccagagagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactaaaaaaaaa

SEQ ID NO: 457043 - DNA, 994 bp, Homo sapiens
ggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagcataattgatatactgtggttactctacctatttgtgtaggcctctcaggtcattgaaacaagatgttgtacaaattagcagatgacactggcgcatggaggaatgagtctagtgttgttaatgagaagttggatatccgtttgatccttgttctactgcaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagatgaaattgaaatggccaatgagcacaccctcattcatccagcgagcattgaggaccccctagaggccaggcccatgagtgatgaagatcccgaggatgaagacgccttgccagccagacagaaacagtctccgccagtcaagaaaccctcaaaagtattttgccatggatatagaagatgaagaaaacatgagtaagatctaggcctatcacgtagtatcagatagctaattttatgttaacattttggtgtttttgcaaatgtatt

SEQ ID NO: 457044 - DNA, 567 bp, Homo sapiens
cctattctggtggccgtggaagagtgtgaggccactgccacggcagatgcacgctcaagtctgcgtatattcctcggcaggcagaattcccccaccacgcacttctgtggccatgtctgagcacagtgtgccgcccgtggctgctccctccctgggggtgaaagcgggcttcacaccaccttcctgtgtcttccgtttcaggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggtactgaggcgccctcaccgcaatgcgccggctccacctccccaatagcttgtctgtcctcacacctactgttccttaagttgtttcatcatgtcatcatgcacagcttccgaaaacgatcacttggaatgattcttccttcagattgttttagcttagaagtgtggctacgtccctgaaaccttaa

SEQ ID NO: 457045 - DNA, 473 bp, Homo sapiens
acctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgcactccttcgtcagttggttgggatcctgcggaattgccagtgcatccctgtaaccacgcaggcttgggctgggctgcgtcgacactgagtccgagctccctgaagactgtgctttcttctccctccagctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctac

SEQ ID NO: 457046 - DNA, 3603 bp, Homo sapiens
ggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactaaaaaaaaa

SEQ ID NO: 457047 - DNA, 5402 bp, Homo sapiens
ggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagcataattgatatactgtggttactctacctatttgtgtaggcctctcaggtcattgaaacaagatgttgtacaaattagcagatgacactggcgcatggaggaatgagtctagtgttgttaatgagaagttggatatccgtttgatccttgttctactgcaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactaaaaaaaaa

SEQ ID NO: 457048 - DNA, 2958 bp, Homo sapiens
  misc_feature (2841)..(2841): n is a, c, g, or t
ggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagcataattgatatactgtggttactctacctatttgtgtaggcctctcaggtcattgaaacaagatgttgtacaaattagcagatgacactggcgcatggaggaatgagtctagtgttgttaatgagaagttggatatccgtttgatccttgttctactgcaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaagtgaagacggagccgtccccgtngacgcggccgcgaatctagtagtagttgtcgacccgggaattttcggaccgtgtccttgcaagcgtaccaattttttcctaatagtgagtctttaattagatgcttgatcgttatcc

SEQ ID NO: 457049 - DNA, 1435 bp, Homo sapiens
  misc_feature (1010)..(1010): n is a, c, g, or t
  misc_feature (1027)..(1027): n is a, c, g, or t
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaagaggatgcattgctcccgganctgcctggccaagagtnagacaaatctcaagatgggacctttctctgtcactcgcacgagcctcggcacccatggcctccaggctggtgatgacccacgcagttctcagcaggcattgcttcaccaacaattggccacagaaaccatggaggccaaccatcaaaaaaaaaaaccagtcctaggcggcagtccatacaccggacctgagcggaacggtataactggcccaagcgacgaggcggacaaaaaacaaccgccacacagaaaatagacaccccaaccacagcacacaggaaggggaagaacaacacaaagagcccacaaaagcgacagcgaaggcaaagacaacgctagaccgaaagacgcacacacaaacgagaaagcaacaacaatgctgcagaagcacgagcaaacggacaacacaa

SEQ ID NO: 457050 - DNA, 448 bp, Homo sapiens
aagggtgcagggcagagggagaggatctgtgggtctcctgggtgtggttttaatctgtctccccctgcccagttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattaggtgaggacactactggaaacagtggacactgtggctggggaaggggaaagatgagagtcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaa

SEQ ID NO: 457051 - DNA, 2102 bp, Homo sapiens
  misc_feature (2010)..(2010): n is a, c, g, or t
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaaaaaaaacaaaaaaaaaaaaaaaaaaaaacaaacaagcacaagacaaaacaacaaaaaaaaaaaagggggggcccccacacaaatcccacccccgcggccccccgtcaccccccctccccgcccggccaccccgcgagcccccggcgccgcgcacccctcaccaacgctcctcccctccctccccntccgcctccgcgcccccccccccggcccccgccgcaccctcccccccgtcccctcccgccgccgctcccccgccctcccctccgccccctca

SEQ ID NO: 457052 - DNA, 1596 bp, Homo sapiens
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtacccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaa

SEQ ID NO: 457053 - DNA, 1400 bp, Homo sapiens
  misc_feature (23)..(23): n is a, c, g, or t
  misc_feature (34)..(34): n is a, c, g, or t
  misc_feature (43)..(43): n is a, c, g, or t
gcaggcagactgtagatagagcnccccccaccgnctgatgcgnttggcgggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaa

SEQ ID NO: 457054 - DNA, 1466 bp, Homo sapiens
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaa

SEQ ID NO: 457055 - DNA, 1125 bp, Homo sapiens
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacctcttattaaaactaacatgaaatatgtgttgttttcatttgcaaatttaaataaagatacataatgtttgtatgagataagaaa

SEQ ID NO: 457056 - DNA, 296 bp, Homo sapiens
tctcccagctctcctcacagaggctgggaattcaggcagctctcatctattgggatggggtcagtggctgaaacatcattcctatgggcaggttttaagggagagggaaaggagtactgaagtgtgcaggcagaggtggtatataagaccaagcaggtagaaactctctcctccttcccccacccacttctgacctcttgttatttctttgatgactagggaggatgccattgctccccggaccctgccctggcccaagagctcagacacaatctccaagaatgggaccctttcct

SEQ ID NO: 457057 - DNA, 333 bp, Homo sapiens
tttaatgggaaagagggtccctggactgatggctaaattgtgtccacagatgtcatccgtgggtctttaagcctcaccaacctttcgtcttccatggctggagtctatgtctgcaaggcccacaatgaggtgggcactgcccaatgtaatgtgacgctggaagtgagcacagagtgaggggtaagtgtggttaagaagagtggtcaatggtgggggaggggttgcaagtggggaggaggcctgtctgctgaggcctgtctctgtagcagggcacggagcttcccctgatcaaatgtttgtacaaatggttggtcagtgactggtcatttcctg

SEQ ID NO: 457058 - DNA, 1825 bp, Homo sapiens
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaa

SEQ ID NO: 457059 - DNA, 1764 bp, Homo sapiens
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaat

SEQ ID NO: 457060 - DNA, 1444 bp, Homo sapiens
ttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaa

SEQ ID NO: 457061 - DNA, 1314 bp, Homo sapiens
aagggtgcagggcagagggagaggatctgtgggtctcctgggtgtggttttaatctgtctccccctgcccagttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaa

SEQ ID NO: 457062 - DNA, 286 bp, Homo sapiens
tgctggtaccggtccggaagtccttatggatctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataataattctgccaaaaaagcct

SEQ ID NO: 457063 - DNA, 3094 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccaccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457064 - DNA, 3898 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccaaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457065 - DNA, 3713 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccaatcgcagcctgcagctgagcgcatgggagagcagcatcgtggatcgtctgatgacgcccactctctccttccttgctcggagtcgcagcgcggtcacactgccccgcaacggccgggaccaccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457066 - DNA, 2821 bp, Homo sapiens
accaaatcagctgctgtaccaaccccacctgactgaggcttaaaaatagcccagcagctgaggggacagagcagggtggcctagggcaggcaggcaccctagcagcctctccctggcacaggactgctaaaagctgggtcagaggagcacaaggaccctcactgtcctgaatccatgggacagcctcggctgggtcagccctctgacagcaggaggggcaagaccttacactgggacatggcagagggcaattgggttttcttccaatcctggatggctccttcctatatgcgccgttcagggccccttcacctggggagcgttgtaggcggggaccctcatccgatgcaggatgttgccctgggaagtgtctggttgcctgggtctgtagtggaagtccagatcatagggaggacaagtgtggccccggtgtgattgtggggagaggactcccgggtgagaagccttggccttggcatggggatggtgcctggtctgctcccttgcctcttcctgcctcctacggcccccacggtgaccggcttcgcctggccttctacccccagatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457067 - DNA, 3895 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457068 - DNA, 4357 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaaggtgtgcggacctgggcggggatttgtgggcggggcctgggcagggcgggccaggtgggcggggcctgggcttagagcggacaggacgggaaagcgctggggcaaattccagttcctgtcctggagagggctgctatgagctgggaggccctaagactccgaggccgggtctggctggtgggaggtttaggattaggggcggggctcgagcctaactgatctgcggcctccaaacagcgtctggaggagatcatgaagaggactcggaagtcagaagtttctgaaaccaaggtcagaattcccccgaagggcagtgctgggcgtggggggcagggtgtgaaaaggaggctgcggaaaggcatccatggccacggagagcgaggctgtcagggaggccgctgcggcccgggcaaggggagggccgaactcagtccgaagtggctggggccggctgtcccttgagcctgactgctcttcctcttcaaagcagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457069 - DNA, 1147 bp, Homo sapiens
aggtcacctagaggatccccactttgcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457070 - DNA, 4003 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataaataaaaaaaaaaacacaaaaaaaacaacacaaaacacacaaacaaaaaacaataaagaaaaaaaaaaacaaaaaaaaaaaa

SEQ ID NO: 457071 - DNA, 3942 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataataattctgccaaaaaagcct

SEQ ID NO: 457072 - DNA, 3827 bp, Homo sapiens
  misc_feature (3772)..(3772): n is a, c, g, or t
  misc_feature (3791)..(3791): n is a, c, g, or t
  misc_feature (3797)..(3797): n is a, c, g, or t
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctcccccatccccagacctggatccccctcagttacagttnaatagagagaggaagatgntcccanggggctttggggggagggtctggtcgacgc

SEQ ID NO: 457073 - DNA, 501 bp, Homo sapiens
ctactactactaaattcgcggccgcgtcgacggaaggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457074 - DNA, 502 bp, Homo sapiens
  misc_feature (21)..(21): n is a, c, g, or t
  misc_feature (36)..(36): n is a, c, g, or t
cgggcctaggcagcctccccncagaaagagtccccnggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457075 - DNA, 3604 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgccctctggccgccggtactcaccaacaccaccaggcctggccggtccttccctgtcctccagtccttctcgcctcagttcccaacacaactggggacttcactgtacagctgtgaaatgtgag

SEQ ID NO: 457076 - DNA, 1409 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctgggtgagtgagcaggaagcctcatcatcttcttcatcgtcatcatcggccttcagagtgtcttgtgtctattcttataaggacactaattctaccagatcttggacccaccttatttaacttaattatttcttt

SEQ ID NO: 457077 - DNA, 163 bp, Homo sapiens
gtgcgggatgggtctccgtgaatccatgtacacgtgtgctcaccgtctgcatactggtgcagtgtgtacacacatccatgttcacggctctgccttatctgtgtctatgtggtcctatttgtgttcacatctacagttgtgtccctgtgttagaatatctggg

SEQ ID NO: 457078 - DNA, 398 bp, Homo sapiens
ccctctcctgctccaccctgaagacccccagctatctgggcttgagtgctgtttgccctgactgtttcccttcctgtttttccccagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgcc

SEQ ID NO: 457079 - DNA, 287 bp, Homo sapiens
atcatggctattttctcaccattatatcatgagtatctggaacagggcccggcacatagaaataactcaaacataagtgaatgaagaagtcggttgaacaagggagagggccacatatggggctgatggcacagatgagcaatctgacctctctcctctcttgtgttggtctttcagctgtggtcgccaggacccccccagagccaagaccttctccagaaggtgacccttcccccccaccaccaccaatgtcagccctggtccccgacactcccccggacacccct

SEQ ID NO: 457080 - DNA, 3824 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccaccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457081 - DNA, 3922 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457082 - DNA, 3141 bp, Homo sapiens
ctgcaacacttaattatgtgcactgtgctaagagcaggacacacatctaatttaatcctcaacccattttgaggaggaaacagaggctcagagagatgaaatcatttgcttaagccacacagctagtagagtagctgacattcagacccagaagcctcctgccaccccaaatcccatgctcttaatcacagtatgtggacatctgtctggtaggccccccaggtcagatggggatcttgcactcaagcattcatttctccttcagccctgagagcccataaggccaatggaggagaaataggcctctcctgagtcctgtcttcagtaagcctctcaatttgagggggttgtctcagactgaaagctccacctaagcaggcgggagaaagacccacccagggcatgggtagcagggctggccacttggaggaaatgtccttggcccaggccttctgcagaacccttcacacacgccactgggctcctttgtccacagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457083 - DNA, 3833 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagccgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457084 - DNA, 4158 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaaggtgtgcggacctgggcggggatttgtgggcggggcctgggcagggcgggccaggtgggcggggcctgggcttagagcggacaggacgggaaagcgctggggcaaattccagttcctgtcctggagagggctgctatgagctgggaggccctaagactccgaggccgggtctggctggtgggaggtttaggattaggggcggggctcgagcctaactgatctgcggcctccaaacagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457085 - DNA, 4152 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataaaaaaaaaaaaaaagggcggccgcccttttttttttcttctattgcctctgagagcatcaggcctagaggcctgactgccaagccatgggtagcctgggtgtaaacctggagatggtggatgatccccacgccacagcccttttgtctctgcaaactgccttcttcggaaagaagaaggtgggaggatgtgaattgttagtttctgagttttaccaaataaagtagaatat

SEQ ID NO: 457086 - DNA, 3943 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataaaaaaaaaacaaaaaaaaaaaa

SEQ ID NO: 457087 - DNA, 820 bp, Homo sapiens
actcttctgtcgaaggaaaccgggctccttcgggcacaaccggctgtgtctgctccagggggccatcagagggtggaacagggacacaggacccattctgggagaggcctccaggaagccctgctgcatgacactgcggatgctgggctcgggcagcagtatcttctgcatggcgcgcgcgccccggcggggcccttggtacgcgtacaaggccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 457088 - DNA, 2906 bp, Homo sapiens
agggcggcagcaaggctcccagacctgtccccagcccagccatcagcaggggagagaaagcgaaaccctttcaggggtctccttgtgactctccttcatgcctcccgacgtcccccgggccgctttggtttaggtgggtttgagcgagaatttggactcgaagctgccctctcagccccagtgccagagcccccaaactccagggtgggaaaggggagtcccagccctgctccccctctcccccagtccccgcggcgggtgagtcacccgagcgctccctacttagtcctcaggcgctgcggcgcgtaccaagacgcggacgcagggggaggcagctagcgcggcgaactcctggagccgtggagcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcaggcctgaaggaggggaggggaagggaggagcagagtgggtattaggaagagcattccgagaagca

SEQ ID NO: 457089 - DNA, 2747 bp, Homo sapiens
  misc_feature (786)..(786): n is a, c, g, or t
tatgtatcaggtactttacatgtgatacctttttttaatgtcttataattttagtttaaaaaaattttaatacacaataactgtacatatttatgggggtacatagtgatgttgcaatacatataacatatagtgattagggtaattagcatatctatcatctcaaaaacttatgtctttgttttgggaacatgcaatatccttcttctagctatttgaaactatacaatattgttaactatagtcatcctacagtgctacagaacactagaacttatacctcctatctagttgtaattgtgtattttacaactttgaagtaggtgtaattatccctatttagactatacctgtatgaaacagaaattattttcattttacagatgaggaaacagacgcagagaagtaatttgtccaaagtccatagggttgtaagactcataacaagaactacaacttgggcctatctgaatcttatacttctggtactatacttgttcacaggtttgaaaagagctttaatttctattatttctcaagaatttgtaatgctttctcttgtcactgtgctttcaacttagaggagttgcagttttgataaaagacaaactgatttagcttctaggtttgttaaatatgtaattcagaggcaactccaggcttatatttctacgactgctttctaaatctaattattttataaatagtcctgttgctttaattcactttttaccctaacataattaatcaagtttaactttgaaatctccatattttatgtgaganctcccaaggctatccacttttattttcctttgtaaatttattgttgctcagcctatttcattaatggcagctttaattataatattttattatattttcaaagtgcatgataatggtttaccagtctggttagtacatcagagatttctattgggagctatcagagatgttaacatccaacaattttaccaaagtgtaattgttatagacgtcttaacatgaatttacgcaacaaaaatatgtttaatgtggagaacagtgagatgcatatttgataattcactgcagtctgcatcatcatctctatattccaaaatttcgtcttaagccgtttagtatttaacttacagaagaaagggggttatcttagataacttttaatatcctaaggtattttccaattcacgatacagggagaaaagaaatgtgtccaggcccttagaagaaaatactttgaatttaaatgtgacacatacattaaacccgcgtgacacgccaggcaggcggtggaagtcaagtgcatttgtttttgtttcatccaccagggcgatctctttcacaattctgggagaggcctgtttgttcctccactcccacagctgaagtttgggacaaagtttgagaaaatcccaggcacctgcggctcctatcgaagccggcgaggagcacagggtagagcgtctcttcccagttttcagtcttcagatcgcaggcctctcggacccgcagagcgagcttcacgctgcagcgcttgagaaataagagctattccaaggaggggccctgggtcctcactgacgcttcgcaaaggtgtacgtccgcccagggaaggccggcggcgcagcgacggcgaggagtccccatccatcttctcttcaagcagcagtagctgggttcgggtacccaaccgacgagccgagacgccagaggccagagtacgaagttggaagcctgcgccccaagccaaccgggattccacttagctccgcgcggtccgcgcctcggccggaagggggcgtggcttcgggcccgcgccgcgaggcccgccgccgagtgggggggtttctcccgggccgcagccgcgcgtttccggcgcgctcccccgcgccctccgtcctgtggtctcgcccgcccccgctgccatgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcaggagaacgagtccctcttcactttcctcggcaagaaatgtgtgctgtatggtatcctatttgtatagctgaactgtgctttatttaatgaactatgtcttcagcagtggtgcagttatatgcagcagatcggaactgtatgtggtcaaagaagtgcagtggtgttgcttgtcttgttaaggacaatccacagagatcttattttttaagaatatttgacattaagagatgggttctgctgttttgcccagcctggattcaaactcctggactcaagtgatcctcctgcctcaggctcccaaagtgctgggattacaggcctgagccaccagtcccgggctaaattagtgcatcttaatgtctgcttccaagacagctgagagatatgacatgcttctgtcactagcagtggc

SEQ ID NO: 457090 - DNA, 6310 bp, Homo sapiens
  misc_feature (786)..(786): n is a, c, g, or t
tatgtatcaggtactttacatgtgatacctttttttaatgtcttataattttagtttaaaaaaattttaatacacaataactgtacatatttatgggggtacatagtgatgttgcaatacatataacatatagtgattagggtaattagcatatctatcatctcaaaaacttatgtctttgttttgggaacatgcaatatccttcttctagctatttgaaactatacaatattgttaactatagtcatcctacagtgctacagaacactagaacttatacctcctatctagttgtaattgtgtattttacaactttgaagtaggtgtaattatccctatttagactatacctgtatgaaacagaaattattttcattttacagatgaggaaacagacgcagagaagtaatttgtccaaagtccatagggttgtaagactcataacaagaactacaacttgggcctatctgaatcttatacttctggtactatacttgttcacaggtttgaaaagagctttaatttctattatttctcaagaatttgtaatgctttctcttgtcactgtgctttcaacttagaggagttgcagttttgataaaagacaaactgatttagcttctaggtttgttaaatatgtaattcagaggcaactccaggcttatatttctacgactgctttctaaatctaattattttataaatagtcctgttgctttaattcactttttaccctaacataattaatcaagtttaactttgaaatctccatattttatgtgaganctcccaaggctatccacttttattttcctttgtaaatttattgttgctcagcctatttcattaatggcagctttaattataatattttattatattttcaaagtgcatgataatggtttaccagtctggttagtacatcagagatttctattgggagctatcagagatgttaacatccaacaattttaccaaagtgtaattgttatagacgtcttaacatgaatttacgcaacaaaaatatgtttaatgtggagaacagtgagatgcatatttgataattcactgcagtctgcatcatcatctctatattccaaaatttcgtcttaagccgtttagtatttaacttacagaagaaagggggttatcttagataacttttaatatcctaaggtattttccaattcacgatacagggagaaaagaaatgtgtccaggcccttagaagaaaatactttgaatttaaatgtgacacatacattaaacccgcgtgacacgccaggcaggcggtggaagtcaagtgcatttgtttttgtttcatccaccagggcgatctctttcacaattctgggagaggcctgtttgttcctccactcccacagctgaagtttgggacaaagtttgagaaaatcccaggcacctgcggctcctatcgaagccggcgaggagcacagggtagagcgtctcttcccagttttcagtcttcagatcgcaggcctctcggacccgcagagcgagcttcacgctgcagcgcttgagaaataagagctattccaaggaggggccctgggtcctcactgacgcttcgcaaaggtgtacgtccgcccagggaaggccggcggcgcagcgacggcgaggagtccccatccatcttctcttcaagcagcagtagctgggttcgggtacccaaccgacgagccgagacgccagaggccagagtacgaagttggaagcctgcgccccaagccaaccgggattccacttagctccgcgcggtccgcgcctcggccggaagggggcgtggcttcgggcccgcgccgcgaggcccgccgccgagtgggggggtttctcccgggccgcagccgcgcgtttccggcgcgctcccccgcgccctccgtcctgtggtctcgcccgcccccgctgccatgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctctgatctgaataatttggatccagaattgaagaatcttttcgatatgtgtggaatcttagaggcacaacttaaagaaagagaaacattaaaagttatatatgactttattgaaaaaacaggaggtgttgaagctgttaaaaatgaactgcggaggcaagcaccaccacctccaccaccatcaaggggagggccacctcctcctcctccccctccacatagctcgggtcctcctcctcctcctgctaggggaagaggcgctcctcccccaccaccttcaagagctcccacagctgcacctccaccaccgcctccttccaggccaagtgtagaagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatttttaaggtgaaatactaaacactactttctgtctgtggattcttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaaaaaaat

SEQ ID NO: 457091 - DNA, 6310 bp, Homo sapiens
  misc_feature (786)..(786): n is a, c, g, or t
tatgtatcaggtactttacatgtgatacctttttttaatgtcttataattttagtttaaaaaaattttaatacacaataactgtacatatttatgggggtacatagtgatgttgcaatacatataacatatagtgattagggtaattagcatatctatcatctcaaaaacttatgtctttgttttgggaacatgcaatatccttcttctagctatttgaaactatacaatattgttaactatagtcatcctacagtgctacagaacactagaacttatacctcctatctagttgtaattgtgtattttacaactttgaagtaggtgtaattatccctatttagactatacctgtatgaaacagaaattattttcattttacagatgaggaaacagacgcagagaagtaatttgtccaaagtccatagggttgtaagactcataacaagaactacaacttgggcctatctgaatcttatacttctggtactatacttgttcacaggtttgaaaagagctttaatttctattatttctcaagaatttgtaatgctttctcttgtcactgtgctttcaacttagaggagttgcagttttgataaaagacaaactgatttagcttctaggtttgttaaatatgtaattcagaggcaactccaggcttatatttctacgactgctttctaaatctaattattttataaatagtcctgttgctttaattcactttttaccctaacataattaatcaagtttaactttgaaatctccatattttatgtgaganctcccaaggctatccacttttattttcctttgtaaatttattgttgctcagcctatttcattaatggcagctttaattataatattttattatattttcaaagtgcatgataatggtttaccagtctggttagtacatcagagatttctattgggagctatcagagatgttaacatccaacaattttaccaaagtgtaattgttatagacgtcttaacatgaatttacgcaacaaaaatatgtttaatgtggagaacagtgagatgcatatttgataattcactgcagtctgcatcatcatctctatattccaaaatttcgtcttaagccgtttagtatttaacttacagaagaaagggggttatcttagataacttttaatatcctaaggtattttccaattcacgatacagggagaaaagaaatgtgtccaggcccttagaagaaaatactttgaatttaaatgtgacacatacattaaacccgcgtgacacgccaggcaggcggtggaagtcaagtgcatttgtttttgtttcatccaccagggcgatctctttcacaattctgggagaggcctgtttgttcctccactcccacagctgaagtttgggacaaagtttgagaaaatcccaggcacctgcggctcctatcgaagccggcgaggagcacagggtagagcgtctcttcccagttttcagtcttcagatcgcaggcctctcggacccgcagagcgagcttcacgctgcagcgcttgagaaataagagctattccaaggaggggccctgggtcctcactgacgcttcgcaaaggtgtacgtccgcccagggaaggccggcggcgcagcgacggcgaggagtccccatccatcttctcttcaagcagcagtagctgggttcgggtacccaaccgacgagccgagacgccagaggccagagtacgaagttggaagcctgcgccccaagccaaccgggattccacttagctccgcgcggtccgcgcctcggccggaagggggcgtggcttcgggcccgcgccgcgaggcccgccgccgagtgggggggtttctcccgggccgcagccgcgcgtttccggcgcgctcccccgcgccctccgtcctgtggtctcgcccgcccccgctgccatgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctctgatctgaataatttggatccagaattgaagaatcttttcgatatgtgtggaatcttagaggcacaacttaaagaaagagaaacattaaaagttatatatgactttattgaaaaaacaggaggtgttgaagctgttaaaaatgaactgcggaggcaagcaccaccacctccaccaccatcaaggggagggccacctcctcctcctccccctccacatagctcgggtcctcctcctcctcctgctaggggaagaggcgctcctcccccaccaccttcaagagctcccacagctgcacctccaccaccgcctccttccaggccaagtgtagaagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctcctatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaaaaaaat

SEQ ID NO: 457092 - DNA, 3776 bp, Homo sapiens
  misc_feature (786)..(786): n is a, c, g, or t
tatgtatcaggtactttacatgtgatacctttttttaatgtcttataattttagtttaaaaaaattttaatacacaataactgtacatatttatgggggtacatagtgatgttgcaatacatataacatatagtgattagggtaattagcatatctatcatctcaaaaacttatgtctttgttttgggaacatgcaatatccttcttctagctatttgaaactatacaatattgttaactatagtcatcctacagtgctacagaacactagaacttatacctcctatctagttgtaattgtgtattttacaactttgaagtaggtgtaattatccctatttagactatacctgtatgaaacagaaattattttcattttacagatgaggaaacagacgcagagaagtaatttgtccaaagtccatagggttgtaagactcataacaagaactacaacttgggcctatctgaatcttatacttctggtactatacttgttcacaggtttgaaaagagctttaatttctattatttctcaagaatttgtaatgctttctcttgtcactgtgctttcaacttagaggagttgcagttttgataaaagacaaactgatttagcttctaggtttgttaaatatgtaattcagaggcaactccaggcttatatttctacgactgctttctaaatctaattattttataaatagtcctgttgctttaattcactttttaccctaacataattaatcaagtttaactttgaaatctccatattttatgtgaganctcccaaggctatccacttttattttcctttgtaaatttattgttgctcagcctatttcattaatggcagctttaattataatattttattatattttcaaagtgcatgataatggtttaccagtctggttagtacatcagagatttctattgggagctatcagagatgttaacatccaacaattttaccaaagtgtaattgttatagacgtcttaacatgaatttacgcaacaaaaatatgtttaatgtggagaacagtgagatgcatatttgataattcactgcagtctgcatcatcatctctatattccaaaatttcgtcttaagccgtttagtatttaacttacagaagaaagggggttatcttagataacttttaatatcctaaggtattttccaattcacgatacagggagaaaagaaatgtgtccaggcccttagaagaaaatactttgaatttaaatgtgacacatacattaaacccgcgtgacacgccaggcaggcggtggaagtcaagtgcatttgtttttgtttcatccaccagggcgatctctttcacaattctgggagaggcctgtttgttcctccactcccacagctgaagtttgggacaaagtttgagaaaatcccaggcacctgcggctcctatcgaagccggcgaggagcacagggtagagcgtctcttcccagttttcagtcttcagatcgcaggcctctcggacccgcagagcgagcttcacgctgcagcgcttgagaaataagagctattccaaggaggggccctgggtcctcactgacgcttcgcaaaggtgtacgtccgcccagggaaggccggcggcgcagcgacggcgaggagtccccatccatcttctcttcaagcagcagtagctgggttcgggtacccaaccgacgagccgagacgccagaggccagagtacgaagttggaagcctgcgccccaagccaaccgggattccacttagctccgcgcggtccgcgcctcggccggaagggggcgtggcttcgggcccgcgccgcgaggcccgccgccgagtgggggggtttctcccgggccgcagccgcgcgtttccggcgcgctcccccgcgccctccgtcctgtggtctcgcccgcccccgctgccatgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctctgatctgaataatttggatccagaattgaagaatcttttcgatatgtgtggaatcttagaggcacaacttaaagaaagagaaacattaaaagttatatatgactttattgaaaaaacaggaggtgttgaagctgttaaaaatgaactgcggaggcaagcaccaccacctccaccaccatcaaggggagggccacctcctcctcctccccctccacatagctcgggtcctcctcctcctcctgctaggggaagaggcgctcctcccccaccaccttcaagagctcccacagctgcacctccaccaccgcctccttccaggccaagtgtagaagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtaagtaagcttttttttttttcattttagatcctttatcataatggaattttaaagtaatttattgaaagatatttttggtgtattcttttttcctcttgctaattcattcttaaccctataaatttatctctatagccatgtcccatatctctatatcctgtgggg

SEQ ID NO: 457093 - DNA, 6364 bp, Homo sapiens
  misc_feature (786)..(786): n is a, c, g, or t
tatgtatcaggtactttacatgtgatacctttttttaatgtcttataattttagtttaaaaaaattttaatacacaataactgtacatatttatgggggtacatagtgatgttgcaatacatataacatatagtgattagggtaattagcatatctatcatctcaaaaacttatgtctttgttttgggaacatgcaatatccttcttctagctatttgaaactatacaatattgttaactatagtcatcctacagtgctacagaacactagaacttatacctcctatctagttgtaattgtgtattttacaactttgaagtaggtgtaattatccctatttagactatacctgtatgaaacagaaattattttcattttacagatgaggaaacagacgcagagaagtaatttgtccaaagtccatagggttgtaagactcataacaagaactacaacttgggcctatctgaatcttatacttctggtactatacttgttcacaggtttgaaaagagctttaatttctattatttctcaagaatttgtaatgctttctcttgtcactgtgctttcaacttagaggagttgcagttttgataaaagacaaactgatttagcttctaggtttgttaaatatgtaattcagaggcaactccaggcttatatttctacgactgctttctaaatctaattattttataaatagtcctgttgctttaattcactttttaccctaacataattaatcaagtttaactttgaaatctccatattttatgtgaganctcccaaggctatccacttttattttcctttgtaaatttattgttgctcagcctatttcattaatggcagctttaattataatattttattatattttcaaagtgcatgataatggtttaccagtctggttagtacatcagagatttctattgggagctatcagagatgttaacatccaacaattttaccaaagtgtaattgttatagacgtcttaacatgaatttacgcaacaaaaatatgtttaatgtggagaacagtgagatgcatatttgataattcactgcagtctgcatcatcatctctatattccaaaatttcgtcttaagccgtttagtatttaacttacagaagaaagggggttatcttagataacttttaatatcctaaggtattttccaattcacgatacagggagaaaagaaatgtgtccaggcccttagaagaaaatactttgaatttaaatgtgacacatacattaaacccgcgtgacacgccaggcaggcggtggaagtcaagtgcatttgtttttgtttcatccaccagggcgatctctttcacaattctgggagaggcctgtttgttcctccactcccacagctgaagtttgggacaaagtttgagaaaatcccaggcacctgcggctcctatcgaagccggcgaggagcacagggtagagcgtctcttcccagttttcagtcttcagatcgcaggcctctcggacccgcagagcgagcttcacgctgcagcgcttgagaaataagagctattccaaggaggggccctgggtcctcactgacgcttcgcaaaggtgtacgtccgcccagggaaggccggcggcgcagcgacggcgaggagtccccatccatcttctcttcaagcagcagtagctgggttcgggtacccaaccgacgagccgagacgccagaggccagagtacgaagttggaagcctgcgccccaagccaaccgggattccacttagctccgcgcggtccgcgcctcggccggaagggggcgtggcttcgggcccgcgccgcgaggcccgccgccgagtgggggggtttctcccgggccgcagccgcgcgtttccggcgcgctcccccgcgccctccgtcctgtggtctcgcccgcccccgctgccatgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctctgatctgaataatttggatccagaattgaagaatcttttcgatatgtgtggaatcttagaggcacaacttaaagaaagagaaacattaaaagttatatatgactttattgaaaaaacaggaggtgttgaagctgttaaaaatgaactgcggaggcaagcaccaccacctccaccaccatcaaggggagggccacctcctcctcctccccctccacatagctcgggtcctcctcctcctcctgctaggggaagaggcgctcctcccccaccaccttcaagagctcccacagctgcacctccaccaccgcctccttccaggccaagtgtagaagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaaaaaaat

SEQ ID NO: 457094 - DNA, 6364 bp, Homo sapiens
  misc_feature (786)..(786): n is a, c, g, or t
tatgtatcaggtactttacatgtgatacctttttttaatgtcttataattttagtttaaaaaaattttaatacacaataactgtacatatttatgggggtacatagtgatgttgcaatacatataacatatagtgattagggtaattagcatatctatcatctcaaaaacttatgtctttgttttgggaacatgcaatatccttcttctagctatttgaaactatacaatattgttaactatagtcatcctacagtgctacagaacactagaacttatacctcctatctagttgtaattgtgtattttacaactttgaagtaggtgtaattatccctatttagactatacctgtatgaaacagaaattattttcattttacagatgaggaaacagacgcagagaagtaatttgtccaaagtccatagggttgtaagactcataacaagaactacaacttgggcctatctgaatcttatacttctggtactatacttgttcacaggtttgaaaagagctttaatttctattatttctcaagaatttgtaatgctttctcttgtcactgtgctttcaacttagaggagttgcagttttgataaaagacaaactgatttagcttctaggtttgttaaatatgtaattcagaggcaactccaggcttatatttctacgactgctttctaaatctaattattttataaatagtcctgttgctttaattcactttttaccctaacataattaatcaagtttaactttgaaatctccatattttatgtgaganctcccaaggctatccacttttattttcctttgtaaatttattgttgctcagcctatttcattaatggcagctttaattataatattttattatattttcaaagtgcatgataatggtttaccagtctggttagtacatcagagatttctattgggagctatcagagatgttaacatccaacaattttaccaaagtgtaattgttatagacgtcttaacatgaatttacgcaacaaaaatatgtttaatgtggagaacagtgagatgcatatttgataattcactgcagtctgcatcatcatctctatattccaaaatttcgtcttaagccgtttagtatttaacttacagaagaaagggggttatcttagataacttttaatatcctaaggtattttccaattcacgatacagggagaaaagaaatgtgtccaggcccttagaagaaaatactttgaatttaaatgtgacacatacattaaacccgcgtgacacgccaggcaggcggtggaagtcaagtgcatttgtttttgtttcatccaccagggcgatctctttcacaattctgggagaggcctgtttgttcctccactcccacagctgaagtttgggacaaagtttgagaaaatcccaggcacctgcggctcctatcgaagccggcgaggagcacagggtagagcgtctcttcccagttttcagtcttcagatcgcaggcctctcggacccgcagagcgagcttcacgctgcagcgcttgagaaataagagctattccaaggaggggccctgggtcctcactgacgcttcgcaaaggtgtacgtccgcccagggaaggccggcggcgcagcgacggcgaggagtccccatccatcttctcttcaagcagcagtagctgggttcgggtacccaaccgacgagccgagacgccagaggccagagtacgaagttggaagcctgcgccccaagccaaccgggattccacttagctccgcgcggtccgcgcctcggccggaagggggcgtggcttcgggcccgcgccgcgaggcccgccgccgagtgggggggtttctcccgggccgcagccgcgcgtttccggcgcgctcccccgcgccctccgtcctgtggtctcgcccgcccccgctgccatgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtctctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctctgatctgaataatttggatccagaattgaagaatcttttcgatatgtgtggaatcttagaggcacaacttaaagaaagagaaacattaaaagttatatatgactttattgaaaaaacaggaggtgttgaagctgttaaaaatgaactgcggaggcaagcaccaccacctccaccaccatcaaggggagggccacctcctcctcctccccctccacatagctcgggtcctcctcctcctcctgctaggggaagaggcgctcctcccccaccaccttcaagagctcccacagctgcacctccaccaccgcctccttccaggccaagtgtagaagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatctggtggtgggcgcctgtagtcccagtcactcaggagcctgaggcaggagaatggtgttgacccatcagtttttgaaatgtatagtgaataggatgttgcactggtggcaattcatcatggagcataataaaattaatttgacccaaatagaataaaaaaaaat

SEQ ID NO: 457095 - DNA, 4237 bp, Homo sapiens
taagaatttttgtgttttaaatttttaaattctatacttctgatagtcaaggtgtatgcgtactggtggggaaaatatcatttgacttaaggatgccagttctggaaaaaatggtagtaataattttaagtaccctttttcttcttgactaataaagttgaaacaaagagttaaggctatatttctttgttaaatttaaaacaaaaatagatactttactttctttatccttgttacaagatatgtttcactttactgttgagcaatgtgttggatatgaggctattataatcaaaatttaagagattagactaattatatttaaattctagctggaagttcatattctttatgaaatttaatggcataaaaatgtaagtttgctttgaaatagtgcatctacactcatttcaagaacttaacaggttttagaaatttaggcagcactttatgaaaaaaatgtagaagtttaaaatataaataatttataatgaagtgatcctatttcagaaaaagtatttaaattgtaaattatgattgtatatcagttatcttaaattatatcccttttatataatttggttttatttgcaggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctctgatctgaataatttggatccagaattgaagaatcttttcgatatgtgtggaatcttagaggcacaacttaaagaaagagaaacattaaaagttatatatgactttattgaaaaaacaggaggtgttgaagctgttaaaaatgaactgcggaggcaagcaccaccacctccaccaccatcaaggggagggccacctcctcctcctccccctccacatagctcgggtcctcctcctcctcctgctaggggaagaggcgctcctcccccaccaccttcaagagctcccacagctgcacctccaccaccgcctccttccaggccaagtgtagaagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaaaaaaat

SEQ ID NO: 457096 - DNA, 1966 bp, Homo sapiens
aaggctgtaccgcccggaatatgggatcgcaggtcgccccggccgggcgggcggggtcgcgcctggtggcggtccccgcgccgaggcgccgctagggcgggcgggggtcgggacgccgggctaggggcgcgtcatgtggccgctcacggtcccgccgccgctgctgctgctgctgtgctcaggcctggccggacagactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctccgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 457097 - DNA, 1993 bp, Homo sapiens
cgcctgggtgtcgagggaccgagcgccccgcggcgggccagagaagggacgcgcggcgggcggccgcggggcatgaggcggaggcgcgatgtcggtgccgctgctcaagatcggggccgtgctgagcaccatggccatggtcaccaactggatgtcgcagacgctgccctcgctcgtggggctcaacggcaccgtgtcccgtgcgggcgcctctgagaaaatcactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctccgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 457098 - DNA, 1670 bp, Homo sapiens
agatccgccacaactcaaggacctccatggactgggagacgttctggaccgtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctccgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 457099 - DNA, 725 bp, Homo sapiens
aactccctcttcctccccccatatattcgttctctaaggaaatctcttcttcctattccccacactctccagtcccctctctgaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctccgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 457100 - DNA, 256 bp, Homo sapiens
gtccagaagctggaaatggccctgacccttggcctctaacccctcactcacaactgaacaacatattgggaccagatttttgagtcttccctcatccctggtcccagctttcccaacttgatcacagcacttcatctttgcctggcctctcttgggctgttcatttccccatcctcattccccctgttcctgcctcccaggctgtgggaagctgaccggggtcagtaaccccatcaccgttcgggccatggggtcc

SEQ ID NO: 457101 - DNA, 2011 bp, Homo sapiens
agactcggagcgagcgagggggcgggggtggggcggaatcccggccgccggcgaggcgggggaggcggcggcgcagggtcgccccggccgggcgggcggggtcgcgcctggtggcggtccccgcgccgaggcgccgctagggcgggcgggggtcgggacgccgggctaggggcgcgtcatgtggccgctcacggtcccgccgccgctgctgctgctgctgtgctcaggcctggccggacagactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctccgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 457102 - DNA, 1690 bp, Homo sapiens
gttccttctgtctgctgtgtagagaattgactacaggtgatgaaggtggaactgggagactagggaggaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctccgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 457103 - DNA, 1566 bp, Homo sapiens
gttccttctgtctgctgtgtagagaattgactacaggtgatgaaggtggaactgggagactagggaggaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctgagccaatgctgtggctcgggctgctgcctggggggcctccgggggctgggggcccttttcattctgcctgtgtccctcaagggtgatctctctgtctctgtcacgccctttctccccgcctttttgctgggcttttgttctctgcctatgtatttctgtctattttttcaatttcccctcttctcctttattgatctctgcttttaatacaccacttctttctttctgcctttttatggatgtctttttctttttatggctctggttctccagttctttccgtctctgcctctctctgtctctctctctctgtccttccacccctccctccttgcttcccacccattcctcatccctcactcccacccccacccccacccccaggagttgagtgcatggatctgtttctttttttatttacactttttctttccggtttgccggaataaacaggacctttgacatttga

SEQ ID NO: 457104 - DNA, 398 bp, Homo sapiens
tcctagcctcgccagtgtcctagcctcgccagtgtcctagcctcgccagtgtcctagcctcgccagtgtcctagcctcgccagtggtcctagcctcgccaggtcagtattaccctgtgaagccccttccctcctttattattcaggagggctgggggggctccctggttctgagcatcatcctttcccctcccctctcttcctcccctctgcactttgtttacttgttttgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457105 - DNA, 430 bp, Homo sapiens
tgcctcggccccagcagccacagcaggaggaggtgacatcacctgtcgtgcccccctctgtcaagactccagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457106 - DNA, 2195 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457107 - DNA, 2707 bp, Homo sapiens
  misc_feature (2202)..(2203): n is a, c, g, or t
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaaaaaaaannaaaaaaaaaaaacaaacaaaaaaaaaaaaaaaaaaaagaggggggggggggcgcgcccagaagaattatctccccgggggggccccacctttatgcggcgttcccccgtttttttttaacaggggggcgcccccaataaggggggacggcgcaattaaaaggacgaggggaaggggcggcggcggttaaacccaccgcggtgcgggggcggggaaacagcggtctcgcgcgggggagaaccttttggggggagagggagacccccattaaattttgggggcgggggggaggacacctaagtggtgggcaacacttaactcatgaaggggagatttttaaagagctgtagagggggaacaaataataaaattttgagggggttatcaagggtgtgttaaacacagggggggatgattgtattgggggtgagaaaaaaatttgggcagacggagaattaaatatggggaacaattttacacgggagtctgtttattaaaaaagggc

SEQ ID NO: 457108 - DNA, 2153 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457109 - DNA, 2164 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccaaaacaagtaaacaaagtgcggggtcggccgggtgctaggccggggccgaggccgaggccggggcgggatccagagcgggagccggcgcgggatctgggactcggagcgggatccggagcgggacccaggagccggc

SEQ ID NO: 457110 - DNA, 2066 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457111 - DNA, 2018 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457112 - DNA, 2121 bp, Homo sapiens
cttactgctaggtacgaggctgggtttactgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457113 - DNA, 2792 bp, Homo sapiens
  misc_feature (2287)..(2288): n is a, c, g, or t
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggtgaggtttctgccttcatctgccctggctgcccccatgccttctcttctctcagcccccatcttactgagctcttctcccccaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaaaaaaaannaaaaaaaaaaaacaaacaaaaaaaaaaaaaaaaaaaagaggggggggggggcgcgcccagaagaattatctccccgggggggccccacctttatgcggcgttcccccgtttttttttaacaggggggcgcccccaataaggggggacggcgcaattaaaaggacgaggggaaggggcggcggcggttaaacccaccgcggtgcgggggcggggaaacagcggtctcgcgcgggggagaaccttttggggggagagggagacccccattaaattttgggggcgggggggaggacacctaagtggtgggcaacacttaactcatgaaggggagatttttaaagagctgtagagggggaacaaataataaaattttgagggggttatcaagggtgtgttaaacacagggggggatgattgtattgggggtgagaaaaaaatttgggcagacggagaattaaatatggggaacaattttacacgggagtctgtttattaaaaaagggc

SEQ ID NO: 457114 - DNA, 2100 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457115 - DNA, 1895 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457116 - DNA, 1742 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagatccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457117 - DNA, 1495 bp, Homo sapiens
aggagacttcaggagagaatttggcttttggggcctctctctggagtgagactattcttcattgatgatggtcagattgtgggtgtctcccctactcccagtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457118 - DNA, 1478 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcagagaaaggtggtgctgcagtggtggccctggggggccattcgattcgcctcagttgctgctgtaataaaagtctactttttgctaaaa

SEQ ID NO: 457119 - DNA, 1257 bp, Homo sapiens
  misc_feature (1)..(1): n is a, c, g, or t
naaacttacggctaggtacgaggctgggtggtgggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457120 - DNA, 1041 bp, Homo sapiens
cccactccatcatgccctccagacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457121 - DNA, 995 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctgatgtcttcctgtgcacatatgaggaaatccagccgactg

SEQ ID NO: 457122 - DNA, 717 bp, Homo sapiens
aaatcagctcggtacctcataggtcgcaggagggagtcaaaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457123 - DNA, 705 bp, Homo sapiens
ttcgtgatctagaggtcccctgcgggtctcttcctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457124 - DNA, 719 bp, Homo sapiens
cctaaagcagtgggtggatctgactgacagtttagccctagtggggctgtctgaagggccccaggtccctcagtcccgtactgtactcaccccctcctgtttctttgtcagatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457125 - DNA, 1080 bp, Homo sapiens
  misc_feature (1)..(1): n is a, c, g, or t
naaacttacggctaggtacgaggctgggtggtgggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457126 - DNA, 471 bp, Homo sapiens
tcctagcctcgccagtgtcctagcctcgccagtgtcctagcctcgccagtgtcctagcctcgccagtgtcctagcctcgccagtggtcctagcctcgccaggtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457127 - DNA, 607 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacatcagtgtcaactcctgccccctccacaacctcagctgcttcccaaaaggaaa

SEQ ID NO: 457128 - DNA, 179 bp, Homo sapiens
gtaagtagtacctggttagtttcttacccatatttcctgatgtagttactccaaacagatttcagggcactactcttctgttctattctgcctctccccactttctttgaatcatatactgtcaagattagggcccctacgggtcttttaaagggtgcgtcctaatgccctaaccacga

SEQ ID NO: 457129 - DNA, 434 bp, Homo sapiens
tgctgatgcagtgcaacattgagtcggtggaggagggagtcaaacaccacgtaaggctcagggctagggttgcgcagggctagtagccagagggtagggaagaaaagtctcattttctgactgtcctattctccagctgacacttctgctgaagttggaggacaaactgaaccggcacctgagctgtgacctgatgccaagtgagtctctcctttccctcagaggatggagagtctatgagccttatcttttagggacatattcaggggtgggggaggtgacaaggcagtaacacattgactcacatagaatgactatcttagaccctaaagcagtgggtggatctgactgacagtttagccctagtggggctgtctgaagggccccaggtccctcagtcccgtactgtactcaccccctcctgtttctttgtc

SEQ ID NO: 457130 - DNA, 516 bp, Homo sapiens
tagcgttcagaggatcccctccataatctgtgccagtggacatctatcctttggcatgtgtgcactggagatggcagtgctggagattcagggcaatggagagtcctcatatgtgccacaggaagccatcagcagtgccatccagcttctagaagacccattacagagggtaaggatcttcaggatcactccctcctcaactgaccttcaaatgtcttctggtttttcttcctttgtacccactgggtatatgctcctaagagctagggaacataacagaaaggacacgaaaaatctataaacattttcttaggaggtgcctaccatgtttttgcatagaaacacacaggtaagggggttaagatggatgatgctggggttaaaagttgtgtgttggaagccgggcatggtggctcacgcctgtaatcccagcactttgggaggccgaggcgggcggatcacgaggtcaggggatcgagaccatcctggctaacatggtgaaaccctgtctctact

SEQ ID NO: 457131 - DNA, 2202 bp, Homo sapiens
cttactgctaggtacgaggctgggtttactgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457132 - DNA, 2280 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggtgaggtttctgccttcatctgccctggctgcccccatgccttctcttctctcagcccccatcttactgagctcttctcccccaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457133 - DNA, 2133 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457134 - DNA, 1904 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457135 - DNA, 2226 bp, Homo sapiens
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagtggcccctctaacagcccagtgcccccacagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457136 - DNA, 1641 bp, Homo sapiens
gattaaagagaacaaggccaggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457137 - DNA, 1713 bp, Homo sapiens
gagatacatgctttcagtgggatccccagaaacgaccaacagctagtcagtgcacttcgatatccttacttccaagttggacacccactagccagctacaacctgggacccggcacaacctgggatgtgctggtcccagggttcttggtgaggcgtagaaccacatagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457138 - DNA, 1127 bp, Homo sapiens
tacccgttatcattaggaggtcagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457139 - DNA, 1027 bp, Homo sapiens
ggctgtctagaggatccgcggaaggggacaggaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457140 - DNA, 1226 bp, Homo sapiens
tactataaagacccatcgcacgagggaagttcgataccgctttctcgttatgaacttctgacgagaaaggctcagagactacccatggaggccctgtaggtcacgtgtctagactcagcagttggtgtaattggcccaagtcatagtccttgtcgcctcatgtatcatgaagatgtctagagttgtgtcgcaagcctcagtgctctctaccgaggattgagcaacaaggcataggatccctcaggttggtgttagtggctcgaaaatccatgacgcgcgtacacgtgacccataagacaaattcaagacttatgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 457141 - DNA, 871 bp, Homo sapiens
  misc_feature (674)..(674): n is a, c, g, or t
  misc_feature (758)..(758): n is a, c, g, or t
  misc_feature (830)..(830): n is a, c, g, or t
  misc_feature (838)..(838): n is a, c, g, or t
ggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaancgttgggtgcacacaaatcctctctgcccctaaagctacctgcactccctgtggacccccccatcaatccaatggggaaacctngaccctgttgacaaccaatcttcaatccaagccacaaacgggactcatcaaagaattggggtcctgttgggntccctggncaaccaattcaaacaaatcaatggtgtaagaac

SEQ ID NO: 457142 - DNA, 562 bp, Homo sapiens
tatgggctactttatttggccttatggccatataagaagcataaatgtattggccattactctaatggcctataacttgtcaggatatgtttaagctttgataaagtttgtttttctttagttctccaagggacttagttggattttgtctttaatcttgcagcatccacaaatccagaagaaatctcaatatatcaaatacctttgttgtgatgatgtgaggacactgcatcagtgggtcaatgggatccgcattgcaaaggcatgtctccttttgatttgatgatggaataatgaggtgtttgtcgatgatatagttttcgttttcatgacaactattctgactatttcatgttcatggatttgccagtgcctacgtttttcaggcctaagtttcaagttttaaatgttgtcttttttccttgtttatagggataaacttttaacatttggtatacttggaataatattgctggtaaaagcttgtgtagtatcaaagtgatttattttggctttggagaatgcattatatgattcttaaatagtagagtttagcctaagc

SEQ ID NO: 457143 - DNA, 495 bp, Homo sapiens
caaccccgccttctgcgtctcggctggacgcgagcacactcggctccgccgccgccgccgccgccgcggggcgctgcggccgccccgcccccgctcccgccgccgcccgccagtcagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcaggtgagtagtgcttgaaaaactggttgaggatttgaagtcaccattgtgttaaaagtttaatgtgcagaaga

SEQ ID NO: 457144 - DNA, 387 bp, Homo sapiens
atccgaattcctaagttacaattctggcgtgaccttaaggcaggggtattaaaaaggctgattctcaatgtaatgcagacatgattgagagactcctctactgatggttcattaattcttttattgtttagagttgatttcatgcaagactgggtgtcaggataccaataatgttatgtgaatcatttattataattatcagtctctcatggtgaaatatttaacactaatctgagatttcttaattccaaggtaagggaagttttctagtagaaaatactggctgtgtttatgatgaaatgagtaaaataacttggtgctgttgtacacagcacttgaccttgtgtaaaagatctaactagacatacatatgaatattgtcagaat

SEQ ID NO: 457145 - DNA, 9689 bp, Homo sapiens
  misc_feature (3124)..(3124): n is a, c, g, or t
caaccccgccttctgcgtctcggctggacgcgagcacactcggctccgccgccgccgccgccgccgcggggcgctgcggccgccccgcccccgctcccgccgccgcccgccagtcagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggccagaatggagtctatgaatcggccctacacttcacttgtgccccctttatccccgcaacctaagatagtcaccccctacactgcttcacagccttcaccacctctacctcctccgccacccccacctcctcctccaccaccccctccaccaccccctcctcccccactccccagccagtctgcaccttctgcaggctcagcagccccaatgttcgtcaagtacagcacaataacacggctacagaatgcgtctcagcattcaggggccctgtttaagccgccaacacccccagtgatgcagtcacagtcagtgaagcctcagatcctggtaccccccaatggagttgttccaccaccccctccccctcctccacccccaaccccaggctctgccatggcccagctaaagcctgcaccgtgtgccccatcccttccacagttcagtgccccgcctcctccactgaagatccatcaagttcagcatattactcaggtggctcccccaacaccccccccacctcctcctatccctgcacccctccctccccaagctcccccaaaaccccttgtgaccatccccgcaccaaccagcaccaagactgtggcacctgttgtgactcaagctgcaccacccacacctactcctccagtgcccccagcaaaaaagcagccagctttccctgcttcttacattccaccctctccccctacccctcctgttccagtacccccgccaacattacccaagcaacagagcttctgtgcaaaaccccctccctctccactgtcaccggtgccctcggtcgtgaagcagatagccagccagtttccaccccctccaactccccctgccatggaatctcagcccttaaagcctgtcccagcaaatgtagctccacagtcccctcctgcagtaaaagcaaagcccaagtggcagcccagctccatcccagtcccttctccggacttccctcctccccctcctgaaagcagcctggtgtttcctcctccacccccatcacctgtcccagccccaccaccnccacctccacccacagcttctcctacccctgacaaaagtggatctccaggcaaaaagaccagtaagacgtccagccctgggggaaagaaaccacccccaaccccacagcgcaactccagcattaaatccagcagtggtgcagagcaccccgagcccaagagaccctcggtggacagtctagtcagcaagtttacaccgccagcagaatcagggtctcccagcaaggagaccctaccacctcctgcagcaccccccaagcctggaaaactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccctgaactgctgtctgatcaacagaaggctggttacggaggcagtcatatatcaggctatgcaacgttgcggagaggaccccctcctgctccccccaaaagagaccagaacaccaagctctccagagactggtagccaccataggactttattttcatgatatctgtaatcactgctacaatcagctcacctgatcatctgtgaattcaggtgttcagagcctcctggtatgatgttattcaggtagtgtccagctatatgtgtatgtgtgtgtgtacacgtgcatgtacacacagctgtacagtgtgtgtatatatgtatacatatatgtatgtgtatgtgtatatagagagagagctgagagttattctatttattccttttctctcctaatctgaaaatgggtgttctgtattttgggtggaagaggcatagaaggggatgtgtgttgtctcttaagatttctatatcatgtggattggaccaaaaacttctaatcacttatttagaaggtatttataagtgtctgtccatgtgtagcctattcgtgcatgttgtgtattatataactaaggaatagatgtagaatgtgctatttctggttgagaaaaatcaccagaatgtttggtgtatctataaggcttttgtgtttgtttttccccagttggctgaagttagaattgcttgactgacacttcattgctatacatgaaggggcactttaaatcaggaaaatctctcagcttcatagaacgggtaactagtgcaggatggggaaatgttcacagacatcatctgtatgtggttgtgcatagaaagtaaatacatggcgtaattaactcagctgttctagctgcagtactgctgcagtgatccacccacatttaggatgtgctgacagataagctctttgcctacaatacatggataattagtgctataattctggatagttcctttttagtactgttttatgaagctttatcaacttggcttcatgatcctcactttgattgattttaagaggatggataacacagttatctctgtaatgttctgtcccagtatgtctttgggtcaccagttaccttcttaaaatatgtgctttaggtaggtgttattacatatctgtagacaattggtatatgaaatatacacatcctgtgccccaatatggtgcattatgaaaaacaaaatcattttctaaaatgcattttttgagcattgctctatagaagggaagggtgatgagagaacagaactggcccctgtacaggtgtcattaatctggttgtatatgggttataatatgtaatacaaaaagctcattaagtatgggactacatggagagggaagacagtttcatttatagctactggggctaccaggacccttgctgactgcagcctggttgtgattagttcaggttactaggtgttctgatggagtgggacagtccaagtccagtaactgacattacgttttatgcgtgtgcagtttggtataacgtggagtcagtgctctaacgacacactatacttctatatgcttttttctgtgaattttccttggtacatgagagaaataagtactctcatcaacttatgataaattggactattaggaataaaacaatctcagagcagctcctaaacaagagaataaaaatgggccatcccagcacttataaggggagcacatcttgtaatgaaagtctgtgcctattgttaatgattaccaatgcaaactgcagaaatcagttgacattgtcccacaaggaaaaagtgatgccagtaaagtgggggaagagatggtaaataattctagaatgagcaaaagtgcttaattagtacagtatactcaaggtcttgcataacccacactccacgaaaaccgcatcgtaaacagagagtgaacagcacctctccattgctacatctccagaatattgttcggttatgttcatgtggttatggagcaataagaatatataccattaatttttaggtctttcaaattgttcaccaagttttgtgtttgatatttatgaagtgatctttaacacatctgcattgttaatttaagcatgcacagaaatttgggtaatgtttgagtagattgccaagcgctactgtgattcatgaatgaatttctcatagtcttctgcctgcagttttatagtttgaggggcacccatatttgtgggttagagttagtaagaatatgaatccagttatcaaagtattcatccctgaggttttgagttttattgtggtggtgattttctcatgagaaggtagacaacacttcagtttttcttgagggggaaaaaatgtacccgctaaccttttttcacccatgatttgagccctaaaacaacagcctttatgttttcagtgcaggatttcttggaatttcttgcttgtatcaatcctgatgatagccatcctgaacagatgcttctggtctgttttcctggaatagcagacatccttttgaacactaatgatgccaggaagagagtaaggctagaggaggagactcattttaaccccagtccagtggcttgtccgacaacaggccatttccctttacattcctccacagacagaaatggctattaaaaatgttttaacctcatgtatgaactgaatttaaaaaaccactaaagtgatactttatacttctgttttactccctagtgggttttctttaatttggatttttgttgggatgtagcttttcctagactgtatttctgtagctctttttctctggtgtattcatggaaagcatctactgccgcacgacactagtactgtgccttctttcactgccctctgctctgcagctctcacccagcttggctgcttcaagtctgtgcagttgacttggctgtactgaaaagtgaacagcatggattaactcatcctgctgctgagggcagtgcaaacaggtgcttattagaggtagtgacttgcttaattagtgacactcctaatttctactatggataatttcaaagtagaatcactctatgcttagagttttggcaccaatgctgtagggcagcagaatctattctcagtaaaataacttatggtttattagatattctgtattggattttaccagcttgacttttactgctcagatgctttctttcccccccttagacgctgtaattctcttgggaagagtaactattcttaaggtttttacagatacccaccttagttgtaaattggatagtttatatttctgggactttttaaatgaaaatgtggaatgttaagttacaaaagacttttcatcagaaaatttcaaacaaagtaaacatggcgttttatagtcctctaaaatctaggtgctcccacccaccaaaggcatatcctgcaaagggctgtgaactatcttggtgaactgtcttgggtcccctttccatgtatgttttcttgtcactgaaaacaaacaacgctgagtttatcaagaaaatttaaattgggggatcataataattccaaccaagtgacaactctgacatcaaggttattaggagctgtacatccaattcaagttttatttgctgctattctgggagaataaacttgtatatggagaataaactaataaacttgtatcgaggaaatccataaagttataaattagcctgaaaaatatttcaggtaatggtgtggattggcctgctttgactctcagccaccaacagaaatctttgtcacctttgttcctcagctaaaagtaattttgttataaacacaaagtgactttaaacaggtaaaaaacccattcctatttttgtacattaccaaaagtttttcatatacctacagagctaactaattacaactgatttaatccactcaagtttagaccagttaaacccataggatcctgtatggttatcaatgtgatgccttgcttttcataaaataggtataattgggtcatacacttgacgagagggtgactgtttctaggggaagaaaaccctttagattgcaggtaactttcacttttttttttttaatatacactttacatttgtataaattatgcagggtactcctaaccctgtagaaatgtatgacctctcacaaagttgagatttgatccaaagagaaatgcaagtataaaagaattagatacttattatcttttaaggtttttttttttttttggtagagatgggggtctcactgtgttgcccaggctggtctcaaactcctggccacaagtgatcttcctgcctcagcctcccaaaatgctgagattacaggcatgagccactgtacccagcctttccttataaaattcaaagagaaaatttctacacctttatccctcaaataaaacaagtgctcagttcttaccgtgcccttgcaaggtctatatgtaaaagaaatctgaaatttagctgtagaataaaacttgataaataaaaagaaaaaacatacatttctccagttggtttgctctttgcttgttgaagtaataaaccgttttaaagagaaaatacttgctgtaaacccccagtgccttcaactcttttggcagaatatttttaaagaaatccagcaagcaaactttgaggtgctaatgaaagtaaaggaaggtggtatttctagttttggcagaaatgaaaagtgtctcacaagagacatcactacccacgtggggtctggctgctttctaccaaagacatttagagaagtgaattgagtcagggtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttttttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgttaaaggggaattgcacattatatttaactgggattgctccctccctcagttctttaaaaaacaagagtcaaggctcacaccaacttgtaggctgtgggagctttgccataggtagatacaatgtagaagtatacttttttaaagcatgaagaagacaaggaacttcattataatgtaccaggtagaggacattattattcaaaggattatgcacagctcagtgaagatgaagttacaatttttctcgcagctttgttgctattattttcttctgcataaatgtatgctcatttcattatgtgccttgctccctgattgtgcaaagctatatatatatatatatatatagatagatagatagatagatatatgagagagatatattcagtactactgaggatgtttttctgaggatgtttttgttctgctggattaagttattttccaagttactcttgccagttatgtcagtaaactattgtaatggcttagcacactagtcgtacagtcagtgtaaatgtttttcatttacatgttttcattatatcagcttatcaaatccttaataaaaaaaattcatagatttcatttaaaaaaaaaaa

SEQ ID NO: 457146 - DNA, 1694 bp, Homo sapiens
aaacaactccacaataaaaagtagtaatgaagaaaaatagcagcagtgttaaagatattgcatagttatgcttcaaatggcataaccatgacacatcttttctggatgttttagtgaagaatacatatttgggggtatcaacagatctttttgtaggcagttatgaaaaataattacaggccaggcgcaatggctcactcctgtaatcccaaaatgctgagattacaggcatgagccactgtacccagcctttccttataaaattcaaagagaaaatttctacacctttatccctcaaataaaacaagtgctcagttcttaccgtgcccttgcaaggtctatatgtaaaagaaatctgaaatttagctgtagaataaaacttgataaataaaaagaaaaaacatacatttctccagttggtttgctctttgcttgttgaagtaataaaccgttttaaagagaaaatacttgctgtaaacccccagtgccttcaactcttttggcagaatatttttaaagaaatccagcaagcaaactttgaggtgctaatgaaagtaaaggaaggtggtatttctagttttggcagaaatgaaaagtgtctcacaagagacatcactacccacgtggggtctggctgctttctaccaaagacatttagagaagtgaattgagtcagggtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttttttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgttaaaggggaattgcacattatatttaactgggattgctccctccctcagttctttaaaaaacaagagtcaaggctcacaccaacttgtaggctgtgggagctttgccataggtagatacaatgtagaagtatacttttttaaagcatgaagaagacaaggaacttcattataatgtaccaggtagaggacattattattcaaaggattatgcacagctcagtgaagatgaagttacaatttttctcgcagctttgttgctattattttcttctgcataaatgtatgctcatttcattatgtgccttgctccctgattgtgcaaagctatatatatatatatatatatagatagatagatagatagatatatgagagagatatattcagtactactgaggatgtttttctgaggatgtttttgttctgctggattaagttattttccaagttactcttgccagttatgtcagtaaactattgtaatggcttagcacactagtcgtacagtcagtgtaaatgtttttcatttacatgttttcattatatcagcttatcaaatccttaataaaaaaaattcatagatttcatttaaaaaaaaaaa

SEQ ID NO: 457147 - DNA, 2699 bp, Homo sapiens
caaccccgccttctgcgtctcggctggacgcgagcacactcggctccgccgccgccgccgccgccgcggggcgctgcggccgccccgcccccgctcccgccgccgcccgccagtcagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccaggtagttcaaaatgcttcaaagcactattttgcgattaatatgaaggtctctgtagagactgatagtagacctggaaatttcaacttgattcttaaaaaccggagccatacttaattcctaaattataatcaatagatgcctttttaaaaattgctagagggtacagtatcatgggctagttcacaaatgtatttgaaatgaaaaatcagtatatagatttctaaagccagttttgttatttatatttataaaatttattcaaaacatacatactgctggacactgttaatgcataatttgggataaaacattacttggaaagaatctttgtactcagaaaccatgaagaagctgcactccttcagattcctatatcctttaaacaagtgcatgctatgattacatcttaacataaatcttctttcaattcaaaatgtttcatgaatgagatccatgtcatctaaaagcagaatttttaaatttttgcattggatgtgatgaaagaaataataactttagtagtatatttaaaagctgcatgactctatttcatctctattaagtaaaaacaaatttagaatgtgtatatacacatacatttcctagtgctgtccactgaggactagaagcagtgataccccaggaacaatgagaatacccagtccctagatcatagaggtttctttttgttttttcgttttattaaattttggccaaggatgctgcttaaatagatcatggtttctaataccattcttcaaa

SEQ ID NO: 457148 - DNA, 436 bp, Homo sapiens
tctttttggtgtttttatcttaggtctctcgggatctggtgtgctttctccagctggatcatgtcaacgtttattatggccaggactatcggaacaaatacaaagcacctacagactattgtctggtgctgaaggtaaacacatatttctttttaggaattttaattgatgttagacatagagcaggttattggatattttagaactgttgagattccatcaattatactgtttttgctttattctcaaagtttaaaaaggaatggtgaagtgtggtaaggaaaagaagcatgtgctatatcatagcagaccctgggccaattatctctaggtaaggagtgaatattagattgtaagctttgagttgtgagatataaaatgtatttgattataaatttgagattctcatttaacaccaggcttattttaggaaaac

SEQ ID NO: 457149 - DNA, 716 bp, Homo sapiens
gcccgtttcacctcctttacctatcattttcttccttactgcattttcacagcatgctatttctctgagatgttccagcaagcaggccaagcgtcatattgacttcacagaagaacaggctgagctgacacctgtaagttctataaacatgccatggcatgacttaatgaagaggaatgcattcattagacctccaaatgatgaaaccttttcatataacttcagtttttcaaataaaaattaaaccaaacttaataaattagcaaaaacaaataagcaactttagatatggtacaactgaatattaatactcctggtatgattatgtaggtggtagcataattgatatagatgatttttgtattagaacctgaaacaacatgccttctttattctgaaactaagggcttttgtaaatttcttaagatactaacaaattgaattgttctttacagcagagctaccaaatggaatgattcttctgcactgatgcttaactgaaagcctagtttctttcttaaaaaaatttattctttggtcattttttttgccatgccatttgccatggttggcaaatctggatgcttcagaggtgtactgtcccatacggtagccactagccacgtgtgcctattaaatatttaaaatgtggttaatctgaattgtgtgctgtaaggataaaatacatactggacttcaaagacttactatgaaac

SEQ ID NO: 457150 - DNA, 2581 bp, Homo sapiens
caaccccgccttctgcgtctcggctggacgcgagcacactcggctccgccgccgccgccgccgccgcggggcgctgcggccgccccgcccccgctcccgccgccgcccgccagtcagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggtaacagcttcgttttaatttacattgaaaattctgtggtattcttttgggtttaaattgttgctctcttatgtctttatcggggatcttatttggccttatttcagtctcctttattaattttcaatcttcctaattgtagtgggtaaagacagttcagagagacctgttgatttgacttccccttggaaatgagtattttacaaattggctctaatgacttaaaatctcaaaaaaacaaaaaaaactggcagtttaattctttcatcagtggctcagatttttaagaaataacaatttcttcctttccacctttaagcagtttggatggcaaacaccatctat

SEQ ID NO: 457151 - DNA, 2691 bp, Homo sapiens
caaccccgccttctgcgtctcggctggacgcgagcacactcggctccgccgccgccgccgccgccgcggggcgctgcggccgccccgcccccgctcccgccgccgcccgccagtcagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaaaacaaatgtaaagaatgtcccccctttacctgcattgctggacttctgtgcatgttggatgcaattgtctcacaccaacacgagtgtgtgtgtcaagcttattcattcctgtgtgactgtgcacgcctgctcaacattctcatactctcctgtgtcagcttactagcatcaaaaagccatcctcattccaccaggaagccctcctaaacccagttatagcatctgcttgatgtggatgcagtcatggactgaaaggtaaactggagccatcacatctccccttggaagtccagtgctcagaggaccgccacagagggttccatgtagggcaggctgtgtcaaagtcatgcagccaaggtcagaagtcatgcatcctgtcaccattcaaacagcttttgcagccggacatttttcctagattgttagatggtctagctattttaccgtggggtaaaacaagttttctgtttccttcttgcccgcacaatcagattttagccttcctgacattgtccatctttatgatcaccaccaacttctgcatccttttcatgcatgtcccagactccctgctttttagttttacacaatcaaagcttacctctgta

SEQ ID NO: 457152 - DNA, 472 bp, Homo sapiens
tcatctgataaaatggtgagctgtgagcttctaagtaaatgtctccctcaagttcctctggttcataatattccttgcagatgttgaacgatgggctggattgttttggaaccttgttccagcagagcccatgtgttcatgaagaaaacatttgcttacagcttatgactaccattgcctctctttcagtgttttttgttgttgttgttgttttggtttttgttttgttttgttttgtttgagaaggagtctcactgcactccagcctgggcgatagagcgagactcagtctcaaaaacaaacaaaacaaaaaatacaaaaattggctgggcatggtgacacatgcccgtaatcccagctacttggaaggctgaggtgcaagaatcacttgaacctgggaggcagatgttgcagtgagccgagatcgatcgtgccaccgcactccagctgggcgactgagcgagactgtctc

SEQ ID NO: 457153 - DNA, 311 bp, Homo sapiens
tcatctgataaaatggtgagctgtgagcttctaagtaaatgtctccctcaagttcctctggttcataatattccttgcagatgttgaacgatgggctggattgttttggaaccttgttccagcagagcccatgtgttcatgaagaaaacatttgcttacagcttatgactaccattgcctctctttcagtgttttttgttgttgttgttgttttggtttttgttttgttttgttttgtttgagaaggagtctcactctgtcacccaggctggagtgcagtggtgtgatcttggctcactgcaacctctgcc

SEQ ID NO: 457154 - DNA, 753 bp, Homo sapiens
  misc_feature (19)..(19): n is a, c, g, or t
aacagtggtatcaacgcanagtgcccattacggccggcattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggcaaaaacaaaagaaaacactccacacacacaacaacaacgcaacgacccaaaaacaaaacaaaagaaacaaaaaaacaccaaaccaccaaaaacacacgaagaaaaacgacaaaacaagaatgccgaggcggccggcgcgcgcgatcgaagcagaagagaaagaaatgaggcaaccaccgacggaggagggcagcgcgccaacaaagaacatgaaagaaacggcacgaggagccgcacacagagaaagacgcggcgacgacaagaggggcggcgccacaaagaaag

SEQ ID NO: 457155 - DNA, 413 bp, Homo sapiens
  misc_feature (371)..(371): n is a, c, g, or t
  misc_feature (392)..(392): n is a, c, g, or t
tgatcagaactgtgcttgaaggcacttccttctacatcattaatcccactgtcaaaacaatacgcaagcatttcggaaagcgactgtcgtgattgttttgtgcgagtatctgtgacgggtgcattttttttcctccctcctataggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaagtgagtcaaaaggatgtccaaagggtcgagatcgtgccnttgtcgcatctgtgattacgngctggctgggtgaactcatga

SEQ ID NO: 457156 - DNA, 2200 bp, Homo sapiens
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttttagaagaccaaactggacaatggactttgctcactatgatgacatgatctccattgacctccatttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457157 - DNA, 2561 bp, Homo sapiens
  misc_feature (2392)..(2392): n is a, c, g, or t
  misc_feature (2396)..(2396): n is a, c, g, or t
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggcaaaaaaaaaaaaaataaaacaaaaaaaaaagggggggggggcaaaaaatttatccccgggggggcccattttcgttccccgttttttgtgaaaagggggccccttaaggggggggatataaaaagaaggggcggggggcgcggtataaaaggtgggggcggaaccccggcccggcgggactctggggagaggaccctactcctgggcgtgggccatcttgggcccctcccccgaagaattaacagtcgggggacataacntacnggtgacggggaccacaggcattggcggggggaattcggttcgcttgttgaaattcgagggctcatacaacacggaccgcacaacaagaatctcgcacacacacaagtatcaacttaaacaatcagcacccgtatgtcacacatacatcagctgtgtcgacacgcc

SEQ ID NO: 457158 - DNA, 2502 bp, Homo sapiens
  misc_feature (2146)..(2146): n is a, c, g, or t
  misc_feature (2154)..(2154): n is a, c, g, or t
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggcagaaacacaacacnaaaacacncacacaaaacacagcaaacaccaacacaaccaacaacataacagaggaggcggcgaccccaataaagtacacccagggagcacaccatatatcgaccacagaatgtccgcgaccaaaggggcccacatatggaggactcatataaacaccatcgccctgtccccgctataaaaacacctgctgagctggaaaacacctatcaccatgggcaaccctgtgaggaacacccctacaagacgcgagtgtgcacactacggggcacacatcacctgcaagaaaatatacatccctgagccaatctcactacgcgcagatccgggtaccccccgctgatattctcctgaccaa

SEQ ID NO: 457159 - DNA, 2044 bp, Homo sapiens
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagtttcacaccaaggaaatagctatgacgtagatcacccctgaattaacgtcccgtgtacgatatggatggacggctggcataacggaattcacgagataatgttaacagtttatactc

SEQ ID NO: 457160 - DNA, 1993 bp, Homo sapiens
  misc_feature (1889)..(1889): n is a, c, g, or t
  misc_feature (1892)..(1892): n is a, c, g, or t
  misc_feature (1894)..(1894): n is a, c, g, or t
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggattgtatnagngngagaaaaggccactttacctacaccggaaacagggaggtcggcacaaccaggtatcatttggggaagaaaagggcggatagtacaagggaaaacgtctg

SEQ ID NO: 457161 - DNA, 1098 bp, Homo sapiens
  misc_feature (22)..(23): n is a, c, g, or t
  misc_feature (33)..(33): n is a, c, g, or t
ccatctactgtcccggagattnnccggcagacnagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457162 - DNA, 1074 bp, Homo sapiens
catcattgtggcgcagtgcacgagacaagagcaggcgtgttcctgggacttggtcgtgccacatgctatatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457163 - DNA, 914 bp, Homo sapiens
ttattcctccttgcattatcctaaaggctcttttctttttattcctacagttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457164 - DNA, 742 bp, Homo sapiens
  misc_feature (19)..(19): n is a, c, g, or t
aacagtggtatcaacgcanagtgcccattacggccggttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457165 - DNA, 968 bp, Homo sapiens
  misc_feature (926)..(926): n is a, c, g, or t
  misc_feature (947)..(947): n is a, c, g, or t
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaagtgagtcaaaaggatgtccaaagggtcgagatcgtgccnttgtcgcatctgtgattacgngctggctgggtgaactcatga

SEQ ID NO: 457166 - DNA, 2133 bp, Homo sapiens
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457167 - DNA, 2009 bp, Homo sapiens
gctatagtcggatgtgcgcctcgccggcgtgtccccgactcccggcagtccttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457168 - DNA, 2417 bp, Homo sapiens
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggcaaaaacaaaagaaaacactccacacacacaacaacaacgcaacgacccaaaaacaaaacaaaagaaacaaaaaaacaccaaaccaccaaaaacacacgaagaaaaacgacaaaacaagaatgccgaggcggccggcgcgcgcgatcgaagcagaagagaaagaaatgaggcaaccaccgacggaggagggcagcgcgccaacaaagaacatgaaagaaacggcacgaggagccgcacacagagaaagacgcggcgacgacaagaggggcggcgccacaaagaaag

SEQ ID NO: 457169 - DNA, 1741 bp, Homo sapiens
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaagggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457170 - DNA, 1141 bp, Homo sapiens
  misc_feature (15)..(15): n is a, c, g, or t
caggctggtaccccncggagtatggatatcgtcgaccacgcgctccgggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagagacttggca

SEQ ID NO: 457171 - DNA, 1255 bp, Homo sapiens
ccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcaagttcgtagggtggaggccaccaaaacgctatggaataaagtattgtctagttgcacgtgggcaggagaggctccatggaggtgatgacaagtaagagaagccagaaagatgggagtatattggggtggtgacaaagcgagtggagatgg

SEQ ID NO: 457172 - DNA, 607 bp, Homo sapiens
ctcagggcctggcggatagtaagtgctcatttaggcaaatgtattccatggcctatggcagtacctgacagttaacttctagagttgagcctctttatgtgaagaaccccatacaaggtactgagaagaaatgttatgagcaagagcgaggagcacagactgaacagacacattctctctcgtgaaaaaattataaatgcctgaaatacacccagaaagtagctctcagtgtgaaaatttcagaaatatacacatcagctgtgaggtgtaggcgtaagtggtcagtcccgaagttgagtttgagctgggtggaatgacattgtgaggcaacggggactggtggagggccagccggggagcaaggtcatgctccgctgaggagtgtgtgctttttggattgtagaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 457173 - DNA, 653 bp, Homo sapiens
gctatctagaggatcccttgtcttgccacaaagtatgccaactgacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtaattttagaaagacacaatg

SEQ ID NO: 457174 - DNA, 1951 bp, Homo sapiens
aggggcgttccctgggccctgcccctccctgccctgctttagttccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 457175 - DNA, 2093 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 457176 - DNA, 2266 bp, Homo sapiens
  misc_feature (2148)..(2148): n is a, c, g, or t
  misc_feature (2151)..(2151): n is a, c, g, or t
  misc_feature (2225)..(2225): n is a, c, g, or t
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaaaaaaaaaaaanctngagggggggccggtacccaattcgcctataggggagcgaatacaattactggccgcggttacacgtgtgctggncctgggtccacttaatcgcttgagacatcccctttgcactg

SEQ ID NO: 457177 - DNA, 2370 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaagataacaaaactgaggctgagtttaagaaacatgcctgtggtcccctgctagtaagaagctaagtaggaactggaatcaaatccatctaaggcccatgctcttctcaattcaccatgtagccaccatgggacggcatcttttgctgaaggggccggcctgccacacccataatgatcactgaaactctgtgctgcggggctgggatgagcagctcttaaaccaaagcctgtctctggaactgaaccttgattctgttgcagaccacccaagggcaagcagctctggccatctcccacttgccggagaaattaaaacgtttttgtggacctctaaagtcgtgtgtgcctgtggcacgatgcctgctgtgcctcatggagaagtgaccatactttccagctgttcagtcccagaccaccctgaaccagagtactgcagagttaattaaggatggacggtgggtaggtgagtgagtggatcccaataccccatcccaggccaactctctcctaagctctctcagttctttcaggccaatttagagagtattcctttgcaaatgatatatgccataagggattgatatgcagaatatataaactaccacaatacaaa

SEQ ID NO: 457178 - DNA, 1780 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtaattttagaaagacacaatg

SEQ ID NO: 457179 - DNA, 1764 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagtgagtttttggagagcagcccttctctgcctgcttggtgttctggcctacagttcctctcaatctgagtagtgctcttttgcgactggcaaaacctgctctgcccctgttctccccttctccaaaatccagcttccagccttcttccctgggcaagttcctctggactaaatgaacgagtaggtctcacccttttctgcgtgtaattattcttcacatggtcatgctcacttcagtcaggaaaagggaagaaactagaggccgaaagctaaggaaagttccctgctcagcagggagtgagtctgggcatctg

SEQ ID NO: 457180 - DNA, 1384 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaccgaagtcacagctacaaaaagtctcttagtcctggcagccaactgcagacaggagccagattataccggtgacggagcctgagcaaggggtggacacagccttgtgctgtgacttggacaccccgagggattcattcttcgtatacccgggcctcacgtacatcacgcttatccgagggtgcgggacacccctcccctccgaatta

SEQ ID NO: 457181 - DNA, 855 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtgggaggagacaagatttattctccccatttcagagatgaagaaactgaggcatggaacttttaggggcccagaattg

SEQ ID NO: 457182 - DNA, 304 bp, Homo sapiens
gtctgctcccgctgtactctccccaaggggtcctgacctattaataacagcctgtgctgggtactttcacataccttctcttacatactatgtatgtcattcttatttcacagataacaaaactgaggctgagtttaagaaacatgcctgtggtcccctgctagtaagaagctaagtaggaactggaatcaaatccatctaaggcccatgctcttctcaattcaccatgtagccaccatgggacggcatcttttgctgaaggggccggcctgccacacccataatgatcactgaaactctgtgc

SEQ ID NO: 457183 - DNA, 2137 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 457184 - DNA, 2053 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 457185 - DNA, 1765 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 457186 - DNA, 1614 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgtatgcgggttcatttttctctaagatgcagtcagtcgacc

SEQ ID NO: 457187 - DNA, 2116 bp, Homo sapiens
aggggcgttccctgggccctgcccctccctgccctgctttagttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaaggaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaagataacaaaactgaggctgagtttaagaaacatgcctgtggtcccctgctagtaagaagctaagtaggaactggaatcaaatccatctaaggcccatgctcttctcaattcaccatgtagccaccatgggacggcatcttttgctgaaggggccggcctgccacacccataatgatcactgaaactctgtgctgcggggctgggatgagcagctcttaaaccaaagcctgtctctggaactgaaccttgattctgttgcagaccacccaagggcaagcagctctggccatctcccacttgccggagaaattaaaacgtttttgtggacctctaaagtcgtgtgtgcctgtggcacgatgcctgctgtgcctcatggagaagtgaccatactttccagctgttcagtcccagaccaccctgaaccagagtactgcagagttaattaaggatggacggtgggtaggtgagtgagtggatcccaataccccatcccaggccaactctctcctaagctctctcagttctttcaggccaatttagagagtattcctttgcaaatgatatatgccataagggattgatatgcagaatatataaactaccacaatacaaa

SEQ ID NO: 457188 - DNA, 490 bp, Homo sapiens
gaaccatcagagaacacaggggctcagaaggctgctgaggctctggaaggccctctggagggaagggaatgcagtcaccaccgtcagtctctgtccccactgtccccccaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 457189 - DNA, 1033 bp, Homo sapiens
  misc_feature (807)..(807): n is a, c, g, or t
aactagctagtacgaggctggtgtgaattcggccgaggagctgactggcaggtgctttaaccacaagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttggcntctcacatggtgtctcggactgagtcggttaaaccccaaaagacacccaacactcctggggggggtttaagaggcccgggagaaaactaactgggccaacctttttttttggaaaccttcttagaaaaccgggttgtctttccgggatacatttgtgaaaaaaaaaccccgttttgtggaaaaaaagacggtctttcccttaagatgctagtaagaaaaaaaaggt

SEQ ID NO: 457190 - DNA, 1255 bp, Homo sapiens
  misc_feature (19)..(19): n is a, c, g, or t
  misc_feature (21)..(21): n is a, c, g, or t
  misc_feature (36)..(36): n is a, c, g, or t
  misc_feature (49)..(49): n is a, c, g, or t
actaaagagctaccaacgntntggtcaacaacccanccgcggttttatntttatacaacacgcagtactatacgtctaggtacagctggtgcaatcggacgaggccggcggtcgaagacgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457191 - DNA, 1246 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacatccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457192 - DNA, 1190 bp, Homo sapiens
  misc_feature (19)..(19): n is a, c, g, or t
  misc_feature (21)..(21): n is a, c, g, or t
  misc_feature (36)..(36): n is a, c, g, or t
  misc_feature (49)..(49): n is a, c, g, or t
actaaagagctaccaacgntntggtcaacaacccanccgcggttttatntttatacaacacgcagtactatacgtctaggtacagctggtgcaatcggacgaggccggcggtcgaagacgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457193 - DNA, 1681 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtagaaaaaaaaaaaaaaaaaaaaaaaaaaaaaaaaaaaaaaaaaaaaaaaaaaaaaggggggggggggtaaaagattcccggggggggccccgtatacgcgcatccccgtagtttttgttgtacaaagagggggctcccgaatggggggtgctatttaaaacgcaagcgcaaggggcccgtgtgttaaaaaaaagctgtcggtcgggggcacactttgttaagtggggagcattatggggaggagaacccctatcattgcgggggggggaccatatgtggccacaactccgtaacgagagttataacgcctcaggggaaattaacaccttgcacgtcgtaatagtggttaacaccagctggatttgttcgcggaaatttggtcacggatatgtcttggaccatttcca

SEQ ID NO: 457194 - DNA, 1205 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457195 - DNA, 1020 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcgtgagttgggagactgggatcttgagttctgtagggagggaggaactagcatttccctagagatgagataaattggatttgaagaagtctcctggttcagtcttttgtcttttggtggaaacattcctccgagttgagattttatat

SEQ ID NO: 457196 - DNA, 789 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457197 - DNA, 1070 bp, Homo sapiens
agaggccgtacggcggaagtatagaaaaggactctctggaacatggcaacattaatctgaccacaagctgactggcaggtgctttaaccacaagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457198 - DNA, 1276 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457199 - DNA, 1032 bp, Homo sapiens
cccggaaggggcgaggccagcggcggggcggggcttatggagatcgtgagctgggcctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457200 - DNA, 855 bp, Homo sapiens
tgttggctggaggagtcagatgggtagggttgcacgtccagctttggtggactgggaaagtcatgtccagcctccggggcagaaggcagaggggacttaaatgacccacatggcagggcttgtctgtgtgtgtctctatcccccagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457201 - DNA, 1546 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtagagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaattttcatcttaaagcactttcattttataccaacgtggaaaagtggcctttttagga

SEQ ID NO: 457202 - DNA, 1205 bp, Homo sapiens
cccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacaacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtag

SEQ ID NO: 457203 - DNA, 388 bp, Homo sapiens
tggggggaggcccagatttccttggattactgcctcattcaccccaatgggcttctctcctaccttgggaccagtgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcgtgagttgggagactgggatcttgagttctgtagggagggaggaactagcatttccctagagatgagataaattggatttgaag

SEQ ID NO: 457204 - DNA, 631 bp, Homo sapiens
tgctcctatcttggttctctaaaagtcgattctcaacaaagaagccatgatgacccttgtaaaatagatcattgccggtagagagcctgcttgccctgctctctacctcctgtttaaattgaaacctgtacactttaagctttttgctcatcgcttggttttgctcttttatgccttaaattatctttgcggcatttttgactcatctgctggggaagaccattccctcaagaaaacttccaacagcaactcaaagcaaactaagatgaaaaaatggggggaaagaatctgtccactgggaacgctttacgtcaccgtgttgctctggaagacagagactgctctgggcacctggcgaggcggctctgcagtgcaggctggggccggtccctgcggcctgctgggctctggcctcgtttggcccatcactcatgctgccgtctcaagcacaagggttgctgtggtgggttttccctctgtttcctgcttcctcactgtcctacccacctgtttcctacagggcagatggcctggcccgtaacactttcctgaaggcatgcgtgagtgaatagaactgttctaatgagtgtatgtttgaacgctttataaatttttaaatacatttctctaa

SEQ ID NO: 457205 - DNA, 615 bp, Homo sapiens
tgttcagggctcagagttggagtcaagtcgccactgtgtttcaggtttctggcagtcggattcatttgcctcacaatactttcctgttgttttttgcagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagtaagccagtctttcagaatctaccaggattcactggaaaagtgaagagaatgtcatttggacagacatgcttctgtgtgtgctttgaagtcacatggcacccaggctttttgttgctctgggtggacttagttgtgtcagcacagacttcgctgcgttcactgtcctcttatcacctggttcagaaacagcatctagtttttat

SEQ ID NO: 457206 - DNA, 834 bp, Homo sapiens
catagatatgaaggaaaatgaagtaaggacaaggagaaaaaagagattgagaaaggcaatgaaaaaagggattattgaagagttgacaaaaaaagaataagggtatatgagaagtagcgaaaaaatagtaatcaacaatcggaagtagattaaggataaatagaatgaaaagggtgattacgaacgaaggagcaatgagtatgtatgggtatgaggagtaagggatataggaagatggtgtgataggaaatgtaagaagagagaagatggacggaggtggaaaaaaacgaaagtgatagaagaaatggaggaagagaatggtgaaaagagtcattatgggattagatgaaagtggagtgatgagaaaacagtcactgtcatttatcttttaacacgcagctcatcctatccataggagccctttcaaggcaggttgcttagctgtccttagccatcaccctcgtagtcttcagcgtcttccttgttgtttggtttgacagcgtattagtccattctcatgcgctgtaaagacatacgttagagtgcagtgatgtgtactccaaatacacgtttgtagaagtcaaattagcaacacattgctctccattgttttttaggcttgcacccttgctcggaggaatgcagacgtcttcctgaaatacctgcacaggaacagcgtgaacatgccaggaatggtgacgcacatcaaagctcctgaacagcaagtgaaaagtgagtagagctgggagtctccaggggtggcccatgccaacagtagcctagaataaaagaaaaaagaaactataaaataaccaaacaaaaaaaacaaacaaa

SEQ ID NO: 457207 - DNA, 10571 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctga

SEQ ID NO: 457208 - DNA, 10442 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataataaatttagggttgatggaatcctctggacagcat

SEQ ID NO: 457209 - DNA, 12399 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457210 - DNA, 10809 bp, Homo sapiens
tgcaatactacttcctattctgtaccttaccccagaaccaaagttctatacgatacttcaacattacctaactcctccctcacctggaatattaactctgctatgcttattaaccagagatatatcaaaaaagaagcagatgtaatggacctaaaaagcaaataagaacttcccagggagcttgtaagtattgcacagcgctctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457211 - DNA, 8903 bp, Homo sapiens
tgttcagggctcagagttggagtcaagtcgccactgtgtttcaggtttctggcagtcggattcatttgcctcacaatactttcctgttgttttttgcagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457212 - DNA, 12297 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457213 - DNA, 8128 bp, Homo sapiens
cagcccttttgcaaccaggaaagactcattttgcacgtttgttgcttgtaagattgcaaatagtcgaatcttgattgtcagatagtaggattttcacatgttggtttccttcccctgaattttttgctcgttgacctgcactggggtctccagtaagagacgctcacaggaagcgaaggatgaaaccagtcacctgtagcctaagaacacaatgtcctcattataactcacatgacagctgagatcactagtgacgttcttataacctaacatggccacaagtaaccaaaacctgtttccttggtctctgttctgcatccttctagaattttactgtcacctaattatataattgtctttttatccagacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457214 - DNA, 12243 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457215 - DNA, 8388 bp, Homo sapiens
catgagaaaaattattaatataaagaattcaagatagtacatgttttcttaaggttcaacaaagaacacttcctcaaagaaattgtaagcagctcagagccacactacaggttgagatatgtggcgaatattccaggtgacttttcgtcagaccaaggcaagggcatccaggtctagtgtggagggcaccgaggaacaggggagcgcacacacaccacagaagctggaagtcagacccgacagttcccacgcagtggacattctcctctgaagccattgtgtggtgtgggacaagggagcgaacatatggaaactttcaaagagagagtaagaatgtttctccgctaaggaaaagatccaatttccaaggaagacaagaaagaacttctaagatacgctttcctaaaaactccttatagttcgcatgcaagaatttacattttcagttctctggctgcttcctgtgaggaagaatgaagatatgtttttaataagtgaggagcggcattacagcacagtgatgtaaccagttggctattaggccgcattacatttctttttttttatcaagtcacatcaggaggtgctgtttggtgtgtgagtctcagggcggacctccctccagatgtacacaaagcccaagtcagggaagccattcagaacggcctgcgtggggagggcaactgtcacttcacatttcactgagtaaggaaattgcagctctggctagtgcaggcggggagagacatctggtttccagggtgcctgaagaatttccttgagctccaattagagtcagtgtggtagaatgaaatccaccgcgtctgggtattcccacttgtgaaacccaactgcagcgcgcgcgcgcgcgcgctcagacgccagcgagggagaggcgcgcgctgggccgggccgtgggctggcgccggccgctgagcaacacgctgccagtctgtgtgcctgtccctgtcgcgtcccagtctgtgtctgagtgtctgtttagctggtcgctgcttttgctgccaagcgggtggctctagctgctgtggagggagaggtaggataggggttctgcacctttagcctccagtcggctccagtcaccatgcccaacggattgaagccagtggacacgctggactcgctgtcctctgtcagttcagcctactgcagcggcgggcagccgggcacctgcaagtactggatcctcgacctagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457216 - DNA, 6183 bp, Homo sapiens
cacgcgtccgcggacgcgtggggtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457217 - DNA, 4465 bp, Homo sapiens
tcccgcccccctgcctctgtcccgccaactctaaacgccaccgcggctgttctcactaactcggctgcccagcgctctccgccgcccgttgcggcctctacctgggaccaggctaaccctcctgcgggccggcccacggcgctactaactactccttgctttgttcgtgtcttctaataagagcaagccgatcattaaccttctcaacgcagcgtcttttggtttcttccatttccaaccagcagaatatcttcttggaactttcttttttaacctctgccttcctcacgcacctattttttggagggttccttttccctgctctctacctcctgtttaaattgaaacctgtacactttaagctttttgctcatcgcttggttttgctcttttatgccttaaattatctttgcggcatttttgactcatctgctggggaagaccattccctcaagaaaacttccaacagcaactcaaagcaaactaagatgaaaaaatggggggaaagaatctgtccactgggaacgctttacgtcaccgtgttgctctggaagacagagactgctctgggcacctggcgaggcggctctgcagtgcaggctggggccggtccctgcggcctgctgggctctggcctcgtttggcccatcactcatgctgccgtctcaagcacaagggttgctgtgagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457218 - DNA, 11772 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaaggtgtgttcgggggtcttcaggagtccgtgtcatcccagcatgagagaaaggatcagggagggcagagactctgcagacctgaagctgggcttgcttatgacctccctcccacccaccagccccgtgccctgcgtgtcctgtagggtcttgttaggggcactatgctggccagcacagggatgggtgcgtcctacaaggaaccaggtagacccctgcacacttccgcaggtgcacatgtggcttctaaagaatatggttaggtttgcaaatgaagcacagagactaggttctcagaagcagcgaaggtgcagagaagctatggctcaggcttccttcagtgttcctgccttaaagccaaggggaagtggctagatgtgggggtgcatatgggctctctggctgtgacagatccccttggggacaacttcagtcagctttagtcctataatcggattgcctgacacctgcggtgggggttgcctggagaaaaagaaggtatctcctgaaagggactctgagcgccaggggccagggcgttggcggctctgcattaggaacgcatctgaggaccagctggactcagcctgtagcatgagaaaaacacacatctaagcagtgtttttgtgtttgtgggtaggaagaaaaagacccacccaaattagtgtgacatgaaacttttgagtgcagtgaaaatgtggtctgttttgattgatgcccaggcaagtcagtttctgcaaatctttcaacaataattgtagccctggaatgaaaggaatacaccttaaagtagctcatttcagttaatgcttgtttgctgtttccatttcagcttctcaatcccaactacatttatgacggtgagttctgttctttttcttctagtcctagagatgattctagacctgtggggcatgtttcagagcacttgagtgtggcctctggaaatgagttttccgtggcgctctaggcgtgcatagcaggttaggtcctatcaatctgtcggggacatgtgggtgggtgtggaggaggagccagggctgatgggcctttaccgactcctttcccatgcagttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtaagcaccgtgcaacgaggattctacgtgacccagtggggcacgtctttcaggagtctccttaagtcctgagtctgcccttacactccaagtggcctgaaagatagaacaataagtcatttgtggggcttcaaaagacagttgtaagtagcagaccagagtgtctgggatgtcacaggagagtgacctctcggcaccttatgtaaagtcgggggagacaccggagctcctgttgctgggaggaggatgggggcctgcctggtgaaggcctctggctgcccaccatggggcaccagggccccccacgaccagcttctgagttggagcagggtgctttccgtgctcctagtactcaaaacactcatatccagctacccagctgaatctggatctggtctaggttggtctcatgtagaatgtgcatgggaaaagcaggaaaggagatgtgggtgagtcccgggcctgcgcaggccctgtgcctgtctgagaccctaacagcaacccttctgggtgaatgcacgccctcctcaccccatccaggaggagccaggcccagggcggctcagtagcttgtccagagcatctggctaggaggcatctgccatggggcctgcttgctccagtgtgaagagcttgttctttctcatcagctaaaccacaagctccctggggcagaaccaatatcttaggctctttcaaaacgtcctgtagttgcctgatgtagatagctgctgagaaaggtgtggactgttctctgctgccatcttgcagaaggccggccatgcagtactgggctgcaccacaaatggaggtgcctccagaggacaaataaaactccaaatgaaagataaattgagtcctggagcaccccgtctgtagacaataagcagaatttgtcttagaacttttgtcccagatatcttaatttcctgtttttaacaacattaaatcagaagacatgttctgattttttggatcatggaacaagaaatctaaaactctagaatttggcagtaaacaataaaaggtaaagattttctaatttgtaaataacacagaaattacacaggtgattttttttttttaatcactggcaaaagctaaaggactttagaaaggtatactattcagctgggcgtagtggctcacacctgtaatcccagcgctttgggaggccgaggtgggtggatcaccaggtcaggagatcgagaccatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtct

SEQ ID NO: 457219 - DNA, 6731 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggtgaggaggtggcgggacaaactctggtgtcaggagtgagtttgctgagaaaataagactcagttggggaaagaaggatttggtaggacaggggaatcatctgtgtaacaggtatattatttctgataagttaaaccttaaaaatttaaatcagctgttactgaaggtgaggtggcgggacagactctggtgtcaggagtgagtttgctgaaaaaataagactcagtgggggaaagaaggatttggtaggacgggaatcatctgtgtaacaagtatattatttctgataagttaatccttaaaaatttaagaaaacacttcaaacaattttctcaattttttatttacatcgagttcagaatgaaaatat

SEQ ID NO: 457220 - DNA, 6995 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggtgaggaggtggcgggacaaactctggtgtcaggagtgagtttgctgagaaaataagactcagttggggaaagaaggatttggtaggacaggggaatcatctgtgtaacaggtatattatttctgataagttaaaccttaaaaatttaaatcagctgttagctgaggcaggaggatagcttgaggccaggagttggaggctgcagtgagcttatgattgctcctttgaatagccactacactccagcctggacaacatagtgagagcttgtctatttaaaaaaaaaaattctttcagaactaaagtgctgaaccccaatgtctggccagtgtgagtggccaaaaaggttagcttgtgtgcattgtctcattcctgtagtcccagctactcaggaggccaaagcaagaggatcacttgaggccaggagttcaagaccacatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtct

SEQ ID NO: 457221 - DNA, 5881 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaaggccaagccatgttccggatttctcaggacctaaatgtgagtttactgtcacttcggtaagaaacaggaagaattaggctgttgtttctccagaaatctgaagagaaaggcagaggattttcagactttggccaaaagccaaaggtgtccacttccatttctggtgaagctgcccatgcatttggaacagcggtgggcttcccctcgtggtgtctttgcatttagagatctgagccatgctggcttttagcctgttgccagaatgctttgcattcagtatattcagttgcatcaatataagtccttgaatttgagttgaaaataaagtacaacttttcctgaaattagtctgttctgcagaggggccctggtgaacttaagcatgcctcaaataacacttgttctgaaggatttcttccgcatgtgcctttcctgtggtgtgttcttacttcctggtgtttgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttt

SEQ ID NO: 457222 - DNA, 4978 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttgtaagtataggcgttcagaattgtaagtctaaaggtaacacaattgcagtctttttgtaggtagagaagaattgttcattgtcttcagtttaacctcccaatctgtcctgaaatgttcaagtctgaattgtggtagggttttcatcttcagtgaaattatttcccaccctcaagtccactagagggtgctctggagtttatagacttaggaaacttgctcttcttaaatcctgtatcatataactgcaggataagaaaacatttcataagtgaaatcatttatctccggtgtgcttaactagctttataaataaaataatcatatctatgactaaaaaa

SEQ ID NO: 457223 - DNA, 4111 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagtaagccagtctttcagaatctaccaggattcactggaaaagtgaagagaatgtcatttggacagacatgcttctgtgtgtgctttgaagtcacatggcacccaggctttttgttgctctgggtggacttagttgtgtcagcacagacttcgctgcgttcactgtcctcttatcacctggttcagaaacagcatctagtttttat

SEQ ID NO: 457224 - DNA, 1648 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaaggtcagtgccttgaacccccagcccacgaggtggtaaccagaatagttcttcctccatgaatattggtgtgtgtgcaaacactcttgtgtagcacatactgtgagctccgcatgtgagctctgaagtcacttggccctgagtttaaattccagctcttttagtccttgctgcgtaaccttaggcaagtgacttagcctctctgttttgttttttcatttgtaaagtagaaataaaagtacctgtttgagtggactg

SEQ ID NO: 457225 - DNA, 1650 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcatataggagaaagcaaaatacatcagcttggtagttaacacatcaaatatttcttgctgttctaggagaacttttggtgtgtgtggaatggctgagcaaatattaaaattgttaatatgcagcatatatggaaggtacctgtggggtgttaacgtgtttgataatgggggggggataatgtgcctcccattcattagaaaatgaggaaaatggtctgggttccaaaatatggaccattgaatggctcaatactacacacacagagcatatatttatatatatgcgaccaatatataggcacgtgaatgctagcaggggtactttaataaccattataatcgggtaatatggggaatcataaaatattcccggactataaattgggcccttggggtaagcctgaaaacctttatggtacaagatcagaattcgtggataaccgtcctttaaagataagcgagaggggtta

SEQ ID NO: 457226 - DNA, 1831 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtcagtttcgcctcatgcccttctgcatgggaaatggcttgtgttgagtagagtttaaatacatcatcatattgg

SEQ ID NO: 457227 - DNA, 854 bp, Homo sapiens
tcccgcccccctgcctctgtcccgccaactctaaacgccaccgcggctgttctcactaactcggctgcccagcgctctccgccgcccgttgcggcctctacctgggaccaggctaaccctcctgcgggccggcccacggcgctactaactactccttgctttgttcgtgtcttctaataagagcaagccgatcattaaccttctcaacgcagcgtcttttggtttcttccatttccaaccagcagaatatcttcttggaactttcttttttaacctctgccttcctcacgcacctattttttggagggttccttttccctgctctctacctcctgtttaaattgaaacctgtacactttaagctttttgctcatcgcttggttttgctcttttatgccttaaattatctttgcggcatttttgactcatctgctggggaagaccattccctcaagaaaacttccaacagcaactcaaagcaaactaagatgaaaaaatggggggaaagaatctgtccactgggaacgctttacgtcaccgtgttgctctggaagacagagactgctctgggcacctggcgaggcggctctgcagtgcaggctggggccggtccctgcggcctgctgggctctggcctcgtttggcccatcactcatgctgccgtctcaagcacaagggttgctgtggtgggttttccctctgtttcctgcttcctcactgtcctacccacctgtttcctacagggcagatggcctggcccgtaacactttcctgaaggcatgcgtgagtgaatagaactgttctaatgagtgtatgtttgaacgctttataaatttttaaatacatttctctaa

SEQ ID NO: 457228 - DNA, 927 bp, Homo sapiens
catcccaaaataaggagttatcgaactttatagttaaaattgagtctaatgaaaagcctatttacaatattaaataaagggttggttatcatgtgggtaacataaacacatattgtcagttaccataataacatcacataacaaagtttcaaccagggttggcaagttctgaactgagggctaagttgggccacattgatacagtttacctgtcacctgtggctgctttcatctgttgtttgtttgagtagttgtgacggagaaacagactgtatgaccccccaaaactgaaagtgtttactgtctaccctacgtagaaatccaggcacagcccagctgagttctgcagctcaaggtcactccttaggctgtgatccagggtcaggccaggtgtgcaaacctctctagactggacggagacagggcttcccttcctccgtgaccgtaagccaggggctgccctctgtttcctgccccatgggcctctctatagggcagaatgtagcagcaggtgtcatcagagcgagggcttcaggagagagagatttttttttaattgaattagattttatcctatgcattttctaaaccagcaggtggccagataaatattttaggtaaagacatacgttagagtgcagtgatgtgtactccaaatacacgtttgtagaagtcaaattagcaacacattgctctccattgttttttaggcttgcacccttgctcggaggaatgcagacgtcttcctgaaatacctgcacaggaacagcgtgaacatgccaggaatggtgacgcacatcaaagctcctgaacagcaagtgaaaagtgagtagagctgggagtctccaggggtggcccatgccaacagtagcctagaataaaagaaaaaagaaactataaaataaccaaacaaaaaaaacaaacaaa

SEQ ID NO: 457229 - DNA, 864 bp, Homo sapiens
agctctagttagtctagtgctttttttcctcgttacttttactgccagtgttgtagtctttctgacaattacaaagactaaaaaattgccctttaatgaatagcccatacgatcttttctctctcttaaaactgtaggacttaaagcagcgtcttggccacaggttacagctcacagatctgttgatcaaaccagtgcagagaatcatgaagtatcagctgttactgaaggtgaggaggtggcgggacaaactctggtgtcaggagtgagtttgctgagaaaataagactcagttggggaaagaaggatttggtaggacaggggaatcatctgtgtaacaggtatattatttctgataagttaaaccttaaaaatttaaatcagctgttagctgaggcaggaggatagcttgaggccaggagttggaggctgcagtgagcttatgattgctcctttgaatagccactacactccagcctggacaacatagtgagagcttgtctatttaaaaaaaaaaattctttcagaactaaagtgctgaaccccaatgtctggccagtgtgagtggccaaaaaggttagcttgtgtgcattgtctcattcctgtagtcccagctactcaggaggccaaagcaagaggatcacttgaggccaggagttcaagaccacatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtct

SEQ ID NO: 457230 - DNA, 630 bp, Homo sapiens
caattggatagatctggtctgactctgtgtactgcagcttgaaatctacataggaatgcctttttgttgtgttactgagagaataatatgataaagtagaactaaggcaccagacaggtgtggtggtacacacctgtagacccggctacttgggaggctgaggcaggaggatagcttgaggccaggagttggaggctgcagtgagcttatgattgctcctttgaatagccactacactccagcctggacaacatagtgagagcttgtctatttaaaaaaaaaaattctttcagaactaaagtgctgaaccccaatgtctggccagtgtgagtggccaaaaaggttagcttgtgtgcattgtctcattcctgtagtcccagctactcaggaggccaaagcaagaggatcacttgaggccaggagttcaagaccacatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtct

SEQ ID NO: 457231 - DNA, 1655 bp, Homo sapiens
ttccgctcggtgatctcgcagatcccgaccgcgcagaagatcatcccggccgagctgccgcaggcccagaccaagggcgccggggccgacgcggcgctcgaggcctctcccatctgtgccgcagtgacctgggagaggccacgctgaagattgtgggcgtgaccacggaagatgacggcatctacacgtgcatcgctgtcaatgacatgggttcagcctcatcgtcggccagcctgagggtcctaggtaagcaccgtgcaacgaggattctacgtgacccagtggggcacgtctttcaggagtctccttaagtcctgagtctgcccttacactccaagtggcctgaaagatagaacaataagtcatttgtggggcttcaaaagacagttgtaagtagcagaccagagtgtctgggatgtcacaggagagtgacctctcggcaccttatgtaaagtcgggggagacaccggagctcctgttgctgggaggaggatgggggcctgcctggtgaaggcctctggctgcccaccatggggcaccagggccccccacgaccagcttctgagttggagcagggtgctttccgtgctcctagtactcaaaacactcatatccagctacccagctgaatctggatctggtctaggttggtctcatgtagaatgtgcatgggaaaagcaggaaaggagatgtgggtgagtcccgggcctgcgcaggccctgtgcctgtctgagaccctaacagcaacccttctgggtgaatgcacgccctcctcaccccatccaggaggagccaggcccagggcggctcagtagcttgtccagagcatctggctaggaggcatctgccatggggcctgcttgctccagtgtgaagagcttgttctttctcatcagctaaaccacaagctccctggggcagaaccaatatcttaggctctttcaaaacgtcctgtagttgcctgatgtagatagctgctgagaaaggtgtggactgttctctgctgccatcttgcagaaggccggccatgcagtactgggctgcaccacaaatggaggtgcctccagaggacaaataaaactccaaatgaaagataaattgagtcctggagcaccccgtctgtagacaataagcagaatttgtcttagaacttttgtcccagatatcttaatttcctgtttttaacaacattaaatcagaagacatgttctgattttttggatcatggaacaagaaatctaaaactctagaatttggcagtaaacaataaaaggtaaagattttctaatttgtaaataacacagaaattacacaggtgattttttttttttaatcactggcaaaagctaaaggactttagaaaggtatactattcagctgggcgtagtggctcacacctgtaatcccagcgctttgggaggccgaggtgggtggatcaccaggtcaggagatcgagaccatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtct

SEQ ID NO: 457232 - DNA, 348 bp, Homo sapiens
cttggatccatgaaatcaaccaaattttagaaaaccagcgcaattttttaaatggtaatgtgtgttctgttactagatgtgtgccttctttcctcgtgtactcacttgtatttatcttccctctcccattcatatccatagtaatgacagaacttagcactcaccactcttcaggcactgcctagatattgctttatttcatcttcacaaccaccctgtgtggccagtactattattattcctgctttacagatgagaaagctggggcactgagcggctgagtaatttgcttcgagtcccacaagttgttgagggcagagtcaggacacagagtggccatctggctct

SEQ ID NO: 457233 - DNA, 514 bp, Homo sapiens
agggatgcttaaagagcccacatattccaaagcatggaacgcccaacactgggtcagaacagaaatttggaacagaactttatctcattttatcaccatatttcatgataatcccccagatagccttcaagcagagttttttttagtctgctgtaagttaaaaaatgagtgtatatataataccactttgtgaggaaggaaatagaatgtctcaggttcaagaaatttggaagctcttatgaaaaatcatattttcatacggagagtgatcacacaacctcggagcactcagctcactccggggcagggtggcaggaacccacctggaggacttcccagctgtacctgaaggcaccatggctcacactggctgacctgtcctctcttcctctgttccccccagctctctggtggctgtgagctgacagtggtgatccatgacttcaccgcttgcaacagcaacgagctgaccatccgacggggccagaccgtggaagttctggagcggccgcat

SEQ ID NO: 457234 - DNA, 10906 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457235 - DNA, 11436 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457236 - DNA, 6041 bp, Homo sapiens
cagattttccctagaggaacttgagctttcactcttctctctcccctcccacagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457237 - DNA, 4034 bp, Homo sapiens
aagagtcattattgcagtgaattttttaagagcgtccctaaattgctttctagagaaattacattttcagttattgaaatagatgcacacagttagccagagggtaaaggaaatgttgaaaatttctcggtgcttgcctggtgagccctgcacggggtcatggtgccatggggcacactgacaagggatttcatgtgatcaggtctcgtttcagttcctccctgcctttctctgtcttcatctgtccctctgcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctagggctcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgaaaaaaaaaaaaaaaaaaaaaaaaaaaaaaaaaaaaaaaaaaaaaaaaaaaaaaaaaaaaaaaaaaaagggggggggggctccttaagaaattctcatccccggggggggccgcccagtatttttgcgtcgtgccggcgctgtttttttttgatgaaacggagggtgcccccattatttgggcggcttttttttaaagacgaggagaccggcgcgggtgttttttcaaccgcctcgcttgtcggcgggggcaacatcgtgttgtgtggagcttttttggtggaggaccacccctcttctggggggggcgccaattgtgcgggaccgagttcctcgg

SEQ ID NO: 457238 - DNA, 6725 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgtaagcacaatagcattgcttatatcctgttctgatggtgtcatccttagtcactggtttgtcagattaaaggagaactcacttatactttatgtaagtgcgtatgtttaagataaaatcaaactgcatggtgttaatgagttggaattaaaatcccttcttcaacatgagttacctgctttcccagtcacctggctgaagctggctatttggctagcaacagtacaggttggtgagagaagaccagagccaggcctgaacagtatctggggtgtctgtgaacaggcaggtattgttgagtggagatgtaactgtacctgcagtgggtttaacataacagccaaatagtgtggatatcgaaaataagcgtattaacattaaagttttttgttttttgggaaaaatcatgatatatttttagaagttagtgacaggagtttttgcatttttgccagtctctttaatgtcttgctaagtaaaagacagctggatttttatatctgcttctgcatccaactcattgctgtgttttttggttcaagtatcc

SEQ ID NO: 457239 - DNA, 6633 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggtgaggcctcccagagaaagtctgacttttggaagctgctctgtgttgctacttgcagatggatttgcccttgtctttgtattgctctgggctgcagaatgtggctgtggcttatggcacatctcaggagtccccatgaccaccctcgggttcactgatttgaaggactcagagaactcaggaaagccattattcccacatttgcagtgtattcccatgaaaggacacagatcaaaataggcaagggaagaactgcatagggcaggtctcagggagtgcctggttcaagctgccagccatgctctcccagtggagtcaggcagacagaggattgccaaccacagcagctcacccgagccttggtgttgagtgtctgtttgggctcagacgcatatggctgactgctctgtgtggctgaccttaggtagtctcctgcccctccagagatcaagacactgtcacattgctagcatagactatttgccttggtcccaggcccccaggtaaacagacattctcatcaagcagaacattccaaggacttacaagttccctcctagaagctgggggcaaacctcactgcacataccctgcctgcagtcactgcaaatgtggtcagctccagtctgtctgaagatgtgccagggtcagtggtacccacagttagactctccgttttgttttgcaacccctgagatctttcatttgggttcacaatgtgtgagagagaagggtttacattattatataagggcttcattttcttagtgatctctttgttgccagttggccaacgtgggttcatttgataaaagccccaaattaaatgttggttctttgaagtt

SEQ ID NO: 457240 - DNA, 5083 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgtaagtaatagattcctaaagagaccataattttccaagttgtgtacataaaatgcggcattactcataactttcacctaattgatagtacaatgttttcatttttgtctatcatttttgtctatcattttgtctatcatgtctattgggctattcttctattgtcttctgtttttaaaagatcctacacaaatactggaagccttatatctgtaaggaactcagattgtaatatatagatgtatgtttgtgtgtgtgtatatgttattatttatattcagtcatttataatatcattactatttatattcaatacattttttcacctgtaatactgtatacagaaggcataaactattaagcttcttttccccctcagtaaaacaaaaataaatgtgaatctttttatttttcctattttaatttcatgatgttacgaattttcaaaaacaacctaccagtaaagttttacaaatagtgccataacaactaggataattagaaggttaactaattgtgttctcattggagtaaacgtagatacaggtcatctgtgttttgaaagctgttgcagcggcttattcagcacaaaagagatggagctttagaacgtgatacacagagtgctttctgggtttccagaacttggtcaaatatgtgccaatacattttgattgaaggataaggtgctattgaatagtgtgcatagtttggtgcataaggttgtgaggatgttggacttgttttctgtctttacacttgtgcatggactggtgggatcatcagctcttatgtgaaagtctggggaagtagaataaacttttcagtttctatctttga

SEQ ID NO: 457241 - DNA, 3332 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagcgtgagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacccagcacaagaccacacgccagcacaagagggatcctctagatcta

SEQ ID NO: 457242 - DNA, 1644 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaaggtaaagacgggggaggctaatgcctcagtggacatgggggaagccagcgctggtgggttcgggtggaaggaaagagaaaaggtggagaatggtaaggctatactcaccgtgtgtgctctaaaccagcgagagtcatttcagaaatggcactgaaatctgttttccggttttactcgttgtgcaatacagtgctgttttagaaattttgagttcaaattacttattctttggtctaggatgcctgtaagataggaatgatattttcacttaaaagagtgaacatttcggccgtgctcacgcctgtaatcccagccctttgggaggccgaggtgggctgatcacctgaggtcaggagattgagaccagtctggccaacatagtgaaaccccgtctctactaaaaatacgaaaattagccgggtgtggtggcacgcgcctgtaatcccagctactcaggaggctgaggcaggagaatcgcttgaacccatgaggcagaggttgcagtgagccaagatcgtgccattgcatttcagcctgggcgacagagtgagactccgtcttaaaaaa

SEQ ID NO: 457243 - DNA, 599 bp, Homo sapiens
cgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgaggtaacttcccccgtgtggctagacccactaaaca

SEQ ID NO: 457244 - DNA, 1007 bp, Homo sapiens
tgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcat

SEQ ID NO: 457245 - DNA, 355 bp, Homo sapiens
accacactcaagtcaccaaggccgcgcgggccagcggccccatttttttttttgtgtatttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctca

SEQ ID NO: 457246 - DNA, 2820 bp, Homo sapiens
tgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatccggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgatttttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttt

SEQ ID NO: 457247 - DNA, 2923 bp, Homo sapiens
tgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaagagtggcccttcctgaagaccagatgtggaacacctgcaagtacatttcatcccactgccctagaccagctccagtatctagaaagactgctcactgggctgaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatccggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgatttttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttt

SEQ ID NO: 457248 - DNA, 2923 bp, Homo sapiens
tgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatccggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgatttttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctca

SEQ ID NO: 457249 - DNA, 2134 bp, Homo sapiens
gctacataaaagtcatttgcagcaactattcaatttccagaattaggttatacttgtgtttgtggttgttttcctgaggaaataatctaataatcagaaaagctaatatttatttgtgtttataagagccaggcactgtggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatccggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgatttttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttt

SEQ ID NO: 457250 - DNA, 790 bp, Homo sapiens
  misc_feature (657)..(657): n is a, c, g, or t
  misc_feature (677)..(677): n is a, c, g, or t
  misc_feature (764)..(764): n is a, c, g, or t
tgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcaggggaancaagaattttaaagaaattnaaaagaaagatgaagaattgttcccattttcttactgggtttgggtaaccaaaatccaagaattttaggaaagaattaaaaagaacngggttttcctgttaaaaaaaaaaggc

SEQ ID NO: 457251 - DNA, 2767 bp, Homo sapiens
tgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacatcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatccggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgatttttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttt

SEQ ID NO: 457252 - DNA, 1524 bp, Homo sapiens
tgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcaggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgatttttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttt

SEQ ID NO: 457253 - DNA, 3718 bp, Homo sapiens
gcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttccaatacaataatatatactcgaggggaggccctgtcccattatccctattggagttctttaacattacatggcct

SEQ ID NO: 457254 - DNA, 3243 bp, Homo sapiens
gcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttcc

SEQ ID NO: 457255 - DNA, 1950 bp, Homo sapiens
gcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcaggtgagacccagggctccaagaggatccaggccaggggcctgtcccccataccgctgggtgctgagctcacgagggcccaactcagccagcccgccgccacttctgctgccggggccaccgaggccctgctgccagccttgatgctttcagaggttgagctcgcttgcccctccttgttgccttttgccctgcgcgcacctcacgccctttgttaccactcagacaagcccaggactgcaagtcaggaacactacatgtcacttctccaggcacagataccctcacccacctgtccctgtcctcaacccaactgcgacttagaggtgggagaatgtgcggagtacctggagtgagccccttcatcactccagccttggtttcctcgccctgaaacagctcttgcaccctaaggtgttttagaggagtgggaagcctgttctacctgttattttagtgataagattaaatgtttaggtttctgca

SEQ ID NO: 457256 - DNA, 596 bp, Homo sapiens
tgttctccacagtggctgccccattttaccttcccgccagcagtgttggagggttccaccttttcatcgtggctagcactggttatcatctcctttgtattctagccacctagtgggtgtgaggcagtatctcttggtggttttgatttgcatttccctgatgactaatgacgctgagcctcttttgatgtgttgagtggccatttgtatgtcttctttggagaaatgtctgttcacgtccttcgcccatgtgtgatcgggttatctctgtcgctgagttgtaaaagctctttgtatattctggatactgcaccctcatcagatgtgtggttcaccagtccagagttttctcccagtctgtaggttgtctttttcactgtctcgatattgtcctttggtgcacaaaagtgttgagttgaatgaggttcagttgatctgtttttctcttgttgctcatgcttttggtgtcctagtgaaggaactattgccatatccaaggtcgtgaagttttatcccattttcttctgagagtttcatactttgggccacactacacatcagcctgtgatgtgctctgggttggtttgtctgtatgg

SEQ ID NO: 457257 - DNA, 3644 bp, Homo sapiens
gcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttcc

SEQ ID NO: 457258 - DNA, 3585 bp, Homo sapiens
gcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtcccaccgccaccgtgtgcctttcccgggccctcagccctcgggccgggcaccacccccagtccccccagtaaaagcctccactggcaaatgcagtccttcc

SEQ ID NO: 457259 - DNA, 3420 bp, Homo sapiens
gcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccatccccccagtaaaagcctccactggcaaatgcagtccttcc

SEQ ID NO: 457260 - DNA, 2261 bp, Homo sapiens
gactgttctccacagtggctgccccattttaccttcccgccagcagtgttggagggttccaccttttcatcgtggctagcactgatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttcc

SEQ ID NO: 457261 - DNA, 1158 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaagaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457262 - DNA, 1614 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457263 - DNA, 478 bp, Homo sapiens
  misc_feature (30)..(30): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaaggcaattattggtgggctcctggatggggcctggtcaccagaaacaccaagccaagattagaagcctggaactttcagccccacctcacccccatccttcagggaggagaagaggaattggacatggagttaataatccatcatgcctacgtggtggggtctccataaagatccctgaagttgagggtctggagattttctgggttgccgacaacatccacatgccaggagagttaccccaactccatgaggacagccctgcacttgggacccttccagattacttctttatctggctatttatttgtatcctttaaaatgtatttgtaataaatcagcaatggtaactaaa

SEQ ID NO: 457264 - DNA, 484 bp, Homo sapiens
tttgcttcagtccaggaggtggaggttgcagtgagtgaagattgcgccactacactccagcctgggcaacagagtgagaccccgtctcaaaaacaaacaaacaacaaaccaaaaacccaacttcctatgtcattatctttgatttaaaaaacaaaaatcattacagtgcggtattactgaatatgcttttatatgtagaattgtgaaccatgtgtctttcagagttgaaaattaattgaattttttgttttttattaggtcgacaaagatgctgaattagtggcccaatggaactattgtactctaagtcaggaaatattaagacgaccaatagttgcctgtgaacttggcaggtatggtttttacacttaatcaagatgagtttgttaagtgattttgaggagaattttgatgtgtaaatgcagttttccattcatcaagcgtggattatcccaagcaaatttgtgaggcataggctgtcgtt

SEQ ID NO: 457265 - DNA, 752 bp, Homo sapiens
  misc_feature (30)..(30): n is a, c, g, or t
  misc_feature (495)..(495): n is a, c, g, or t
  misc_feature (534)..(534): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaaggcaattattggtgggctcctggatggggcctggtcaccagaaacaccaagccaagattagaagcctggaactttcagccccacctcacccccatccttcagggaggagaagaggaattggacatggagttaataatccatcatgcctacgtggtggggtctccataaagatccctgaagttgagggtctggagattttctgggttgccgacaacatccacatgccaggagagttaccccaactccatgaggacagccctgcacttgggacccttccagattacttctttatctggctatttatttgtatcctttaaaatgtatttgtaataaatcagcaatggtaactaaaaaaaaaaaaaaaaaaanaaaaagcccggggggcttcttattttcggggttccgggnaacatgggcttgttccaacctgtgcatgtgggccatgctgtgttcctgccccagcttttgttggtcacatgcggggaaatcagcgcggcaccccctaacagtcgaacggagtaatttcagattagccggtatacctgtgatatttggtccacaacggttgggctggcaattttggtacttcatcgcattcctctaaccccgaaaggcctgcccgagcc

SEQ ID NO: 457266 - DNA, 352 bp, Homo sapiens
aataaattaataaaataaattcagcaggattgtttttgtcttctttttttcttttctcttcctattttcttccaaatgtgctgtcctgttaaattattcagatttggcatttgaagaatgggaaagagtggtgcagtctacacagtgaaggaaaaaacaagaacgggaaggagtgggacatggaatatgatgtatgtgaaaatgtcattcgagggccagggagggtcttatgtctggattttcatactggggataaagtttgatgtatcccttagtgaataagccccaaaacacttatttctgttaaattgaacattttataaagaattatgtagtctttgttctgaacttt

SEQ ID NO: 457267 - DNA, 2111 bp, Homo sapiens
  misc_feature (1631)..(1631): n is a, c, g, or t
  misc_feature (1642)..(1642): n is a, c, g, or t
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttcaaaaaaaaaaaaaaaanaaaaaaaaaanaaaaaaaaaaaaaaaaaaaaaaaaaaaaaacaaaagaacaaacagaaaaagaaaagaaagaagaaagataaacgaaggagaggccaccagcaacagaacggcacccagagcaatcggaatacacgagccaaccctatcatgaccagggcgatcagacgagacatacattgatactagcaagcgcgggaacgctagagcacacactgacgctgactgaatgtgttgctcgacaaacaggtaaaagaaactaagccaacaacaatcaacccataaagagaaacaacagataaacttactaacatcaaaatggcttgaaagtaaaaataaaatatagctgatactccattagaacatacaaaacaaaaactaaactccattaccaactcctccgcgcatcaatactaatacacaaataagcagcaaagcacaacattaatataccagaaaaaaacatacacctatcgtccac

SEQ ID NO: 457268 - DNA, 1533 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaagccttgttggtctagctaaatactgttaggggagtgtgccccatctcatcatttcgaagatagcagagtcatagttgggcacccagtgattgggttcaaaaataaagctggtctgcctcttc

SEQ ID NO: 457269 - DNA, 1560 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457270 - DNA, 1687 bp, Homo sapiens
  misc_feature (30)..(30): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaagatttggcatttgaagaatgggaaagagtggtgcagtctacacagtgaaggaaaaaacaagaacgggaaggagtgggacatggaatatgatgtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457271 - DNA, 2094 bp, Homo sapiens
  misc_feature (30)..(30): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaaggcaattattggtgggctcctggatggggcctggtcaccagaaacaccaagccaagattagaagcctggaactttcagccccacctcacccccatccttcagggaggagaagaggaattggacatggagttaataatccatcatgcctacgtggtggggtctccataaagatccctgaagttgagggtctggagattttctgggttgccgacaacatccacatgccaggagagttaccccaactccatgaggacagccctgcacttgggacccttccagattacttctttatctggctatttatttgtatcctttaaaatgtatttgtaataaatcagcaatggtaactaaatacagatatgtaaaaacttaaaagaagaaagaccctaggaaagaagagagaccctgatttggcatttgaagaatgggaaagagtggtgcagtctacacagtgaaggaaaaaacaagaacgggaaggagtgggacatggaatatgatgtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457272 - DNA, 1743 bp, Homo sapiens
  misc_feature (30)..(30): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaagtacagatatgtaaaaacttaaaagaagaaagaccctaggaaagaagagagaccctgatttggcatttgaagaatgggaaagagtggtgcagtctacacagtgaaggaaaaaacaagaacgggaaggagtgggacatggaatatgatgtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457273 - DNA, 1260 bp, Homo sapiens
tctagaggagcgtatttttttatggtgagaaggaagacacgcatttacatgcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457274 - DNA, 1284 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457275 - DNA, 1151 bp, Homo sapiens
cagaagtgcatgactggtgtcacatgcagagggtgaaggctttaggagttacggaacatcaaaagccttcttcagagtgactgtctgtctcatgtgactagcatcggtcagtcagacagggcacccgggacaatgggcagccacactgacgctgaagtggagtgaatctgagcacagcctccaacattctctatctttttgtagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457276 - DNA, 1568 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaaggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagggtaagatccttcaagagatccttattttagcaaaatgcgactctagggcagtctgctaatatgttcatgctttgttttgcattgtttttgctttgcctactttgtttcttttacagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457277 - DNA, 1419 bp, Homo sapiens
  misc_feature (950)..(950): n is a, c, g, or t
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttcaaaaanaaaaaaaaaaaaaaaaaaaaaaaaaaaaaacaaaagaacaaacagaaaaagaaaagaaagaagaaagataaacgaaggagaggccaccagcaacagaacggcacccagagcaatcggaatacacgagccaaccctatcatgaccagggcgatcagacgagacatacattgatactagcaagcgcgggaacgctagagcacacactgacgctgactgaatgtgttgctcgacaaacaggtaaaagaaactaagccaacaacaatcaacccataaagagaaacaacagataaacttactaacatcaaaatggcttgaaagtaaaaataaaatatagctgatactccattagaacatacaaaacaaaaactaaactccattaccaactcctccgcgcatcaatactaatacacaaataagcagcaaagcacaacattaatataccagaaaaaaacatacacctatcgtccac

SEQ ID NO: 457278 - DNA, 719 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatgacttctttaaggcttttaactaagcctgttcatctacccctatgttctcttctttttgtctccagttgttgctctcctctcctcgt

SEQ ID NO: 457279 - DNA, 908 bp, Homo sapiens
  misc_feature (30)..(30): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaaggcaattattggtgggctcctggatggggcctggtcaccagaaacaccaagccaagattagaagcctggaactttcagccccacctcacccccatccttcagggaggagaagaggaattggacatggagttaataatccatcatgcctacgtggtggggtctccataaagatccctgaagttgagggtctggagattttctgggttgccgacaacatccacatgccaggagagttaccccaactccatgaggacagccctgcacttgggacccttccagattacttctttatctggctatttatttgtatcctttaaaatgtatttgtaataaatcagcaatggtaactaaatacagatatgtaaaaacttaaaagaagaaagaccctaggaaagaagagagaccctggtaaacacattttttactgctttttcgggggaaacaattttcaaagccctggataaggagtgatttgtcacttttctccctgtccccaactctctgaggtgctttttgaatataacctaatctcttggtgcctcactttcctcatcttcaaaagtaaaaatactaactcatagagtttttctgaggattaaaaagttatggaaactgcttagcacagtgcctggcacacagtaagcacttaagcagtttttactttaaaaattaaattcagagggccaggtgtgttggcttacgcctgtaaactcagccctttgggagatcgaggcaggagaatcacttgagctcagcagttggagaacagcctgggcaacaca

SEQ ID NO: 457280 - DNA, 1465 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaaccttgttggtctagctaaatactgttaggggagtgtgccccatctcatcatttcgaagatagcagagtcatagttgggcacccagtgattgggttcaaaaataaagctggtctgcctcttc

SEQ ID NO: 457281 - DNA, 1559 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctctttgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457282 - DNA, 1895 bp, Homo sapiens
  misc_feature (30)..(30): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaaggcaattattggtgggctcctggatggggcctggtcaccagaaacaccaagccaagattagaagcctggaactttcagccccacctcacccccatccttcagggaggagaagaggaattggacatggagttaataatccatcatgcctacgtgtacagatatgtaaaaacttaaaagaagaaagaccctaggaaagaagagagaccctgatttggcatttgaagaatgggaaagagtggtgcagtctacacagtgaaggaaaaaacaagaacgggaaggagtgggacatggaatatgatgtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457283 - DNA, 1731 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaaaacaaagaaacccaaggcagcagagtctgtttcaaaaccagatgtcagtgaagggtaagatccttcaagagatccttattttagcaaaatgcgactctagggcagtctgctaatatgttcatgctttgttttgcattgtttttgctttgcctactttgtttcttttacagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457284 - DNA, 1559 bp, Homo sapiens
ggctggggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctgggaaaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457285 - DNA, 1026 bp, Homo sapiens
ccaggtacggactgtgtgaccgtgcctgacacaacggactggatggacgacgaacggctgagacgcgacgctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttc

SEQ ID NO: 457286 - DNA, 728 bp, Homo sapiens
  misc_feature (30)..(30): n is a, c, g, or t
  misc_feature (728)..(728): n is a, c, g, or t
aaaacagaacatgagtcaaggtacgaggcngggtgttggctctgactcccgtcctgcgatgggttgcgacgggggaacaatccccaagaggcatgaactggtgaaggggccgaagaaggttgagaaggcaattattggtgggctcctggatggggcctggtcaccagaaacaccaagccaagattagaagcctggaactttcagccccacctcacccccatccttcagggaggagaagaggaattggacatggagttaataatccatcatgcctacgtggtggggtctccataaagatccctgaagttgagggtctggagattttctgggttgccgacaacatccacaaggaggatgtggacgtgctgaagacaaggatggaggagagaaggctgagagcgaagctgggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagaatggatgagagctttcttgtaaagctgtgaagctcgtgttgggcacaaagaggggcatatctgcagtgagaaatggaggctacaatgcctttttaacacatacaggtcggcgcttaaaggggagagttggcactgtgtacacacatgctctggtttggcccn

SEQ ID NO: 457287 - DNA, 611 bp, Homo sapiens
ggcgaccttatcactgagctggggaaggcagctgccatgagtcattttaagtctctgagctccagcccagttctaggggcacaaggctggagtagggatactcctagttacctgcttgaggaaaagcacgaagaaattggtatcaaagtcttggctttgttctgggagttgagggaaaagtagggaggtatttaagtggcttgattatgagaaaacaccagagacagtagtaaatagttatttaccgatttttacccatttctaccctggtaatcctccctgcaaatgaagaaaaccaagacttctttatttattatctttccccatctgtattgaaacagtgatcttacttatctcacccagtgactctgtaggacatttaaaaagtggtcatgggtttcattggagtgagaatggtattaacgtttcctcttgtcatctcaaagttttctctccccttaataccatctctacagcttgctgagatgctttaaggatcacagagacacaaagaaaatttgaaccctacgcttctcccatcccacttcttactccatcccgggtgagcgctcgtcctcaaataaagcatgttggaacttccaaatatctct

SEQ ID NO: 457288 - DNA, 366 bp, Homo sapiens
cgccactgggagaacccaactcaaaatcaacctgtacctttttcatttggtggctcctctcattcctccaactgaacatctttgtggaaagatgatggctgcctgcacccactgctggcgaatggtgagaaggtagagcaagggggccaagttgctgctggtgggcacctggggttcaggccggcccaactgtggctgagccgatctgtagctgagctgagtgtcaaccagctgtgtccacaccctgcctgaggcctgccctctcctccctggctggggtgggaccttgaagaggcatatcttcccactaggtgaggaggaacaagagcctcactccccttctccctcttgcctttcacagctgag

SEQ ID NO: 457289 - DNA, 609 bp, Homo sapiens
cgccactgggagaacccaactcaaaaaaaaaaaaagttttgggttatggagcatttttgattttggatctttgggttaaggacgctcaacctgtacctttttcatttggtggctcctctcattcctccaactgaacatctttgtggaaagatgatggctgcctgcacccactgctggcgaatggtgagaaggtagagcaagggggccaagttgctgctggtgggcacctggggttcaggccggcccaactgtggctgagccgatctgtagctgagctgagtgtcaaccagctgtgtccacaccctgcctgaggcctgccctctcctccctggctggggtgggaccttgaagaggcatatcttcccactaggtgaggaggaacaagagcctcactccccttctccctcttgcctttcacagctgaggcagagcttatgggaggagtcactatgggagtgatggacctgggctttggtctccagtgtttggcaggggcgaccttatcactgagctggggaaggcagctgccatgagtcattttaagtctctgagctccagcccagttctaggggcacaaggctggagtagggatactcctagttacctgct

SEQ ID NO: 457290 - DNA, 2729 bp, Homo sapiens
  misc_feature (1291)..(1292): n is a, c, g, or t
  misc_feature (1311)..(1311): n is a, c, g, or t
  misc_feature (1315)..(1315): n is a, c, g, or t
  misc_feature (2196)..(2196): n is a, c, g, or t
tctctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctnnccccagtgagcccctgganctcntggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457291 - DNA, 2729 bp, Homo sapiens
  misc_feature (1291)..(1292): n is a, c, g, or t
  misc_feature (1311)..(1311): n is a, c, g, or t
  misc_feature (1315)..(1315): n is a, c, g, or t
  misc_feature (2196)..(2196): n is a, c, g, or t
tctctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggagcctatagcaaacccaccctctcagccctgcccagccctgtggtggcctcaggggggaatatgaccctccgatgtggctcacagaagagatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctnnccccagtgagcccctgganctcntggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457292 - DNA, 2646 bp, Homo sapiens
  misc_feature (1208)..(1209): n is a, c, g, or t
  misc_feature (1228)..(1228): n is a, c, g, or t
  misc_feature (1232)..(1232): n is a, c, g, or t
  misc_feature (2113)..(2113): n is a, c, g, or t
tctctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctnnccccagtgagcccctgganctcntggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457293 - DNA, 2593 bp, Homo sapiens
  misc_feature (2060)..(2060): n is a, c, g, or t
tctctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457294 - DNA, 391 bp, Homo sapiens
gactgcttgtgagggttggaggtcacgaaggaaagacctggctcgcgcctgcacacagtaggtgctcacatcaatgacatcattcccactcctgacgtcctcatgtcaaggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctgtaagaggaagagaggggacaaatgggggtgctggagagacaggagtccc

SEQ ID NO: 457295 - DNA, 1672 bp, Homo sapiens
tctctgtcctgccagcactgagggctcatccctctgcagagcgcggggtcaccgggaggagacgccatgacgcccgccctcacagccctgctctgccttggtgagatttcaagatggggagggggagatccgagtcttggaggaaccccaccccacacacaagccctggtccatcaggagacctcaaaagctcaggaggcacccgggcggggacctgctcaggcttcagggcaaatgcctcacagggaactctcttccagggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagcaaggaggtaa

SEQ ID NO: 457296 - DNA, 2757 bp, Homo sapiens
  misc_feature (1291)..(1292): n is a, c, g, or t
  misc_feature (1311)..(1311): n is a, c, g, or t
  misc_feature (1315)..(1315): n is a, c, g, or t
  misc_feature (2224)..(2224): n is a, c, g, or t
tctctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctnnccccagtgagcccctgganctcntggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgggctgagactctgtccatcttcacccagaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457297 - DNA, 2780 bp, Homo sapiens
  misc_feature (1291)..(1292): n is a, c, g, or t
  misc_feature (1311)..(1311): n is a, c, g, or t
  misc_feature (1315)..(1315): n is a, c, g, or t
  misc_feature (1398)..(1398): n is a, c, g, or t
  misc_feature (2247)..(2247): n is a, c, g, or t
tctctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggagcctatagcaaacccaccctctcagccctgcccagccctgtggtggcctcaggggggaatatgaccctccgatgtggctcacagaagagatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctnnccccagtgagcccctgganctcntggtctcaggacactctggaggctccagcctcccacccacagggccgccctccacacctggaggtcctgaggaccagcccctnaaccccccagggtcaggccctcagaatggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457298 - DNA, 1395 bp, Homo sapiens
atgacccccatcctcacggtcctgatctgtctcgggctgagtctgggccccaggacccacgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcagcctcacacgccaaggattacacagtggagaatctcatccgcatgggcatggcaggcttggtcctggtgttcctcgggattctgttatttgaggctcagcacagccagagaaacccccaagatgcagcaaggaggtaa

SEQ ID NO: 457299 - DNA, 2889 bp, Homo sapiens
  misc_feature (1451)..(1452): n is a, c, g, or t
  misc_feature (1471)..(1471): n is a, c, g, or t
  misc_feature (1475)..(1475): n is a, c, g, or t
  misc_feature (2356)..(2356): n is a, c, g, or t
tctctgtcctgccagcactgagggctcatccctctgcagagcgcggggtcaccgggaggagacgccatgacgcccgccctcacagccctgctctgccttggtgagatttcaagatggggagggggagatccgagtcttggaggaaccccaccccacacacaagccctggtccatcaggagacctcaaaagctcaggaggcacccgggcggggacctgctcaggcttcagggcaaatgcctcacagggaactctcttccagggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctnnccccagtgagcccctgganctcntggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457300 - DNA, 1373 bp, Homo sapiens
  misc_feature (840)..(840): n is a, c, g, or t
caggaaggcctgtgaggctgcagccaaatgggcaaggtcagagtgaggagcagaggccagaaccacagggagggagcggccagaccctccacggccttagggcgtccctgagattccatcaggaaagggatgtaatcggatcaccccgggaacagtgaggaaaattgactccaggaggtcagggggactcaaggacaccccccaccactgtctctctccagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggtgagtcctttcctctccaggcccccaggcctcccccacccccaccacgttccttacctctcactctcccccgctgcaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaanacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcga

SEQ ID NO: 457301 - DNA, 1056 bp, Homo sapiens
cctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattatagatgtgagccactgcacccagcccttcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaaaaaaaagtgatg

SEQ ID NO: 457302 - DNA, 514 bp, Homo sapiens
aacaaggctacaggctgggagtcactgccgaagtgataagctgtgggtggtgaatgcagagaaggccacaatagtgaaactccatctcaaaaaaaaaaaaaaaaaaagttgtattagaatctggccacacccctttgtgtgtgtattacttagaattgctttagcaacctccatactataacttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacccttgtggcctgcattttaacaaacatatacacaaacacattttttaaatttgctagaaatcttccctcccattttcaagtgtggttaatcaattgaccaaaacccagttttctttctttctttctttctttttttgagggtgacagagcaagatcttctgtctcggaa

SEQ ID NO: 457303 - DNA, 1419 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaaaggaaaaaaaaacaaaacaaaagaaaacaacaaca

SEQ ID NO: 457304 - DNA, 2132 bp, Homo sapiens
  misc_feature (3)..(3): n is a, c, g, or t
  misc_feature (1361)..(1361): n is a, c, g, or t
  misc_feature (1856)..(1856): n is a, c, g, or t
  misc_feature (1864)..(1867): n is a, c, g, or t
  misc_feature (1876)..(1876): n is a, c, g, or t
  misc_feature (1888)..(1888): n is a, c, g, or t
  misc_feature (1909)..(1910): n is a, c, g, or t
  misc_feature (1923)..(1923): n is a, c, g, or t
  misc_feature (1926)..(1927): n is a, c, g, or t
  misc_feature (1934)..(1934): n is a, c, g, or t
  misc_feature (1942)..(1942): n is a, c, g, or t
  misc_feature (1957)..(1957): n is a, c, g, or t
  misc_feature (1962)..(1963): n is a, c, g, or t
  misc_feature (1981)..(1981): n is a, c, g, or t
  misc_feature (1992)..(1992): n is a, c, g, or t
  misc_feature (1994)..(1994): n is a, c, g, or t
  misc_feature (2004)..(2004): n is a, c, g, or t
  misc_feature (2007)..(2008): n is a, c, g, or t
  misc_feature (2016)..(2016): n is a, c, g, or t
  misc_feature (2023)..(2023): n is a, c, g, or t
  misc_feature (2028)..(2028): n is a, c, g, or t
  misc_feature (2051)..(2051): n is a, c, g, or t
  misc_feature (2062)..(2063): n is a, c, g, or t
  misc_feature (2065)..(2065): n is a, c, g, or t
  misc_feature (2068)..(2068): n is a, c, g, or t
  misc_feature (2072)..(2072): n is a, c, g, or t
  misc_feature (2076)..(2078): n is a, c, g, or t
  misc_feature (2082)..(2082): n is a, c, g, or t
  misc_feature (2085)..(2086): n is a, c, g, or t
  misc_feature (2090)..(2091): n is a, c, g, or t
  misc_feature (2093)..(2093): n is a, c, g, or t
  misc_feature (2097)..(2097): n is a, c, g, or t
  misc_feature (2108)..(2108): n is a, c, g, or t
  misc_feature (2114)..(2114): n is a, c, g, or t
  misc_feature (2124)..(2124): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagccgagtgtggtggtacaggcctgtaatcccagttactagggaggctgaggcaggagaatcacttgaacctgggaagcagaggttgtgatgaaccgngattgcaccattgcactccagcctgggccacaagagtgaaactccatctcaaaaaaaaaaaaaaaaaaagttgtattagaatctggccacacccctttgtgtgtgtattacttagaattgctttagcaacctccatactataacttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacccttgtggcctgcattttaacaaacatatacacaaacacattttttaaatttgctagaaatcttccctcccattttcaagtgtggttaatcaattgaccaaaacccagttttctttctttctttctttctttttttgagcagcctggacgacagagctagactgtctccaaaggaaaaagttgtactnggccgggnnnngtggctcangcctgtaatccnagcactttgggaggccaaggnnggcggatcatgangtnnggagttngagaccancctggccaacatggngaaannctgtctctactaaaaatncaaaattagcngngtgtggtggnacnngcctgtantcccagntactngggaggctgaggcaggagaatcncttgaacctgnnangcngagnttgnnntganccnngatnncnccantgcactccagnctggcnacagagtganactctctc

SEQ ID NO: 457305 - DNA, 1713 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaaggaccttttgtttatactttttttttttttaaccaagaagtcaatttccaacctgagtccttttgaatttaccctgctggaaaaacctaggattcatttgggaggccatgagaaagaaaagagtcagtggtagagtttccttttgggatttagctcaataaatgatggtcaagaattgggcaagtggggctgcgcgcagcggctcatacctgtaatcccagcactttggacggcgcgaggtaggcggatcacttgcggtcaggagttcgaaactagcctggccaacatggtgaaatcgcatctctactaaaaatagaaaaattagccag

SEQ ID NO: 457306 - DNA, 2824 bp, Homo sapiens
  misc_feature (3)..(3): n is a, c, g, or t
  misc_feature (1361)..(1361): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagccgagtgtggtggtacaggcctgtaatcccagttactagggaggctgaggcaggagaatcacttgaacctgggaagcagaggttgtgatgaaccgngattgcaccattgcactccagcctgggccacaagagtgaaactccatctcaaaaaaaaaaaaaaaaaaagttgtattagaatctggccacacccctttgtgtgtgtattacttagaattgctttagcaacctccatactataacttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacccttgtggcctgcattttaacaaacatatacacaaacacattttttaaatttgctagaaatcttccctcccattttcaagtgtggttaatcaattgaccaaaacccagttttctttctttctttctttctttttttgagctctgtcacccaggctggagtgcagtggcgcaatctcagctcactgcagcctccgcctcccgggttcaggcgattttcttgcctcagcctcccaagtagctgggactacaggcagaaaccccatctctactaaaaatacaaaaattagccaggcgtggtggcacgtacctgtaatcccagctacttggaaggctgacaggagaatcgcttgaacctgggaggcggaggttgcagtgagcagagatcgtgccattgcactccagcctgtgcagcaagagtgaagctctgtctcagaaaaaaaaaaaaaaaaggaacaaacagaaacagaggtttatctgcactccagcctgggcgacagagcaagactccgtctcaaaaaaaaaaaaaaaaatgacatcttactagtggatcctgtttcctgttcattggtgtctagtttacattattatcttggcagttggtggtaaacctaggcaaaagagtgtggactgtgccaagggaactgtggaaatgttaggggaaataaagctttacatctaattagagtacattgtgtgcatgagaaagaaggtggaaaaggtggttgcagcagaaagcaagttggaggtgtagctcagacctgggttctgtgtcttggcccttctgcacctccacgtcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaaaaaaaagtgatg

SEQ ID NO: 457307 - DNA, 1837 bp, Homo sapiens
  misc_feature (3)..(3): n is a, c, g, or t
  misc_feature (1361)..(1361): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagccgagtgtggtggtacaggcctgtaatcccagttactagggaggctgaggcaggagaatcacttgaacctgggaagcagaggttgtgatgaaccgngattgcaccattgcactccagcctgggccacaagagtgaaactccatctcaaaaaaaaaaaaaaaaaaagttgtattagaatctggccacacccctttgtgtgtgtattacttagaattgctttagcaacctccatactataacttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacccttgtggcctgcattttaacaaacatatacacaaacacattttttaaatttgctagaaatcttccctcccattttcaagtgtggttaatcaattgaccaaaacccagttttctttctttctttctttctttttttgagggtgacagagcaagatcttctgtctcggaa

SEQ ID NO: 457308 - DNA, 2235 bp, Homo sapiens
  misc_feature (3)..(3): n is a, c, g, or t
  misc_feature (1361)..(1361): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagccgagtgtggtggtacaggcctgtaatcccagttactagggaggctgaggcaggagaatcacttgaacctgggaagcagaggttgtgatgaaccgngattgcaccattgcactccagcctgggccacaagagtgaaactccatctcaaaaaaaaaaaaaaaaaaagttgtattagaatctggccacacccctttgtgtgtgtattacttagaattgctttagcaacctccatactataacttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacccttgtggcctgcattttaacaaacatatacacaaacacattttttaaatttgctagaaatcttccctcccattttcaagtgtggttaatcaattgaccaaaacccagttttctttctttctttctttctttttttgagctctgtcacccaggctggagtgcagtggcgcaatctcagctcactgcagcctccgcctcccgggttcaggcgattttcttgcctcagcctcccaagtagctgggactacaggcagaaaccccatctctactaaaaatacaaaaattagccaggcgtggtggcacgtacctgtaatcccagctacttggaaggctgacaggagaatcgcttgaacctgggaggcggaggttgcagtgagcagagatcgtgctgctgctaaaaaacacaaaaattagctgggcgtggtgacgggtgcctgtaatcccagatactcaggaggctgaggcaggagaatcgcttgaacccggaaagtggaggttgcattgagctgagattgagccattgcactccagcctgggcaacaagagcaaaactccatctcaaaaaaa

SEQ ID NO: 457309 - DNA, 1843 bp, Homo sapiens
  misc_feature (3)..(3): n is a, c, g, or t
  misc_feature (1361)..(1361): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagccgagtgtggtggtacaggcctgtaatcccagttactagggaggctgaggcaggagaatcacttgaacctgggaagcagaggttgtgatgaaccgngattgcaccattgcactccagcctgggccacaagagtgaaactccatctcaaaaaaaaaaaaaaaaaaagttgtattagaatctggccacacccctttgtgtgtgtattacttagaattgctttagcaacctccatactataacttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacccttgtggcctgcattttaacaaacatatacacaaacacattttttaaatttgctagaaatcttccctcccattttcaagtgtggttaatcaattgaccaaaacccagttttctttctttctttctttctttttttgagcctgggcaacaagagcaaaactccatctcaaaaaaa

SEQ ID NO: 457310 - DNA, 967 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagcca

SEQ ID NO: 457311 - DNA, 992 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccaaccgtggacatagtggtaccgagcc

SEQ ID NO: 457312 - DNA, 1293 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457313 - DNA, 1219 bp, Homo sapiens
gattgcctgagactgggtaatttataaacaaaagaggttgcagtgagcagagatcgtgctgctgctaaaaaacacaaaaattagctgggcgtggtgacgggtgcctgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457314 - DNA, 1330 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457315 - DNA, 1078 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457316 - DNA, 1054 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457317 - DNA, 987 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457318 - DNA, 918 bp, Homo sapiens
tgtaattctccctctgcaggacgttgctgatgaatgccggggcggtgctgaactttaagctgaaaaagaaggacacgcagggctttggggaggagtccaggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457319 - DNA, 1414 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaaggggcttgcttctgacatgtctgatgagcgcattcctgctgttgctcctggctattacaaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattatagatgtgagccactgcacccagcccttcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaaaaaaaagtgatg

SEQ ID NO: 457320 - DNA, 876 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagcca

SEQ ID NO: 457321 - DNA, 1285 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttgctcctggctattacaaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattatagatgtgagccactgcacccagcccttcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaaaaaaaagtgatg

SEQ ID NO: 457322 - DNA, 661 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagcca

SEQ ID NO: 457323 - DNA, 878 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgagaaaactcaagcagattgcctttccatctagcactggggccataactctgatactactgttaacgaattgtgagatttgctgtaaatggatttaggaaaagacacgacgggagaatctggtgttcttggcctctgtgggtccatccctgtatgcttcccccagaaagagagaggacaaaaagttgtctgtcctgagtgattgagactccgaatgtggggttgctgtccagtctgcgtgccaccccagtggctgtttgcgaagatgcttccaggacataggagatctggggaggatggcatttcaccctcatcacaaggaccgtgatgtattcccaggaagactgttgccaaggtatcctacctggcagagaggatctgagagcatgtatgagacttgcctaggaacaaagaaggcttgtgaggagatcaaggaacttacatgaaattgtaggaacggccaggggcagtggctcaggcctgtaatcccagtactttgggaggccaaggtgggagaattgcttgagcccaggagttcaagaccagcctgggcagcatggtgaaaccctgtctttaccaaaaataaaaaaattagccgagtgt

SEQ ID NO: 457324 - DNA, 1426 bp, Homo sapiens
atcattcttttttgtttgtttgagacagtctggacgacagagctagactgtctccaaaagaaaaagttgtactgggaccgggcacagtggcccacctcagcctcctgaagttttgggattacaggcgtgagctgctgcaactggcctctttctcttgatagttagacgaaagacccctctcaggctccctgagactcctcagaacagcagaacagcagcagtgcgatgttggataatgagatctgctctcttctgaagtggttagatttgaaaagccagcgaagctgtcattagcaaggcattttcttttcatttcaaccatttcattatatcctttaccaaatttgagtttatgaaatatttgacaggcctcctgatgttttcctatgttgatgaaagacggatgctgtttgtgtaaaaggaaaaggcatgctataaaaagaaaaagaaggataaaaagggccgggcagggaggctcatgcctgtaatcccagaagttcgagaccagcctggccaacatggtgaaaccccatctctactaaaaatacaaaaattagccaggcgtggtggcacgtacctgtaatcccagctacttggaaggctgacaggagaatcgcttgaacctgggaggcggaggttgcagtgagcagagatcgtgccattgcactccagcctgtgcagcaagagtgaagctctgtctcagaaaaaaaaaaaaaaaaggaacaaacagaaacagaggtttatctgcactccagcctgggcgacagagcaagactccgtctcaaaaaaaaaaaaaaaaatgacatcttactagtggatcctgtttcctgttcattggtgtctagtttacattattatcttggcagttggtggtaaacctaggcaaaagagtgtggactgtgccaagggaactgtggaaatgttaggggaaataaagctttacatctaattagagtacattgtgtgcatgagaaagaaggtggaaaaggtggttgcagcagaaagcaagttggaggtgtagctcagacctgggttctgtgtcttggcccttctgcacctccacgtcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaaaaaaaagtgatg

SEQ ID NO: 457325 - DNA, 1378 bp, Homo sapiens
aacaaggctacaggctgggagtcactgccgaagtgataagctgtgggtggtgaatgcagagaaggccacaatgtacagcacctaccctgggagtgttcacttggggttcatgttggaacccattttgcttcctccaccattgcacattgaaggagaatgtatttttgcacgcgcttctcattgcccttcatgtacatctgctctagggcaggagtcagcaaactacagcccagagggcatgtctggcccacggcttgtttttgtaaataaagttttattggagccgggtgcggtggctcacaactgtaatccccacactttgggaagctgagccaggcgatcccttattagcctgaccgctgtggcaaaatcctttctctactaaaaatacaaaaactagccgggtgtcgtgctgcacgcttatagtccaagctactcaggaggctgaggcaggagaattgcttgaacccaggaggaaaccccatctctactaaaaatacaaaaattagccaggcgtggtggcacgtacctgtaatcccagctacttggaaggctgacaggagaatcgcttgaacctgggaggcggaggttgcagtgagcagagatcgtgccattgcactccagcctgtgcagcaagagtgaagctctgtctcagaaaaaaaaaaaaaaaaggaacaaacagaaacagaggtttatctgcactccagcctgggcgacagagcaagactccgtctcaaaaaaaaaaaaaaaaatgacatcttactagtggatcctgtttcctgttcattggtgtctagtttacattattatcttggcagttggtggtaaacctaggcaaaagagtgtggactgtgccaagggaactgtggaaatgttaggggaaataaagctttacatctaattagagtacattgtgtgcatgagaaagaaggtggaaaaggtggttgcagcagaaagcaagttggaggtgtagctcagacctgggttctgtgtcttggcccttctgcacctccacgtcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaaaaaaaagtgatg

SEQ ID NO: 457326 - DNA, 826 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgtgacaacatccgggaattcttgctgagcctcagatactttcgaatcttcatcgccctgtggaacatcttcatgatgttctgcatgattgtgctgagaaaactcaagcagattgcctttccatctagcactggggccataactctgatactactgttaacgaattgtgagatttgctgtaaatggatttaggaaaagacacgacgggagaatctggtgttcttggcctctgtgggtccatccctgtatgcttcccccagaaagagagaggacaaaaagttgtctgtcctgagtgattgagactccgaatgtggggttgctgtccagtctgcgtgccaccccagtggctgtttgcgaagatgcttccaggacataggagatctggggaggatggcatttcaccctcatcacaaggaccgtgatgtattcccaggaagactgttgccaaggtatcctacctggcagagaggatctgagagcatgtatgagacttgcctaggaacaaagaaggcttgtgaggagatcaaggaacttacatgaaattgtaggaacggccaggggcagtggctcaggcctgtaatcccagtactttgggaggccaaggtgggagaattgcttgagcccaggagttcaagaccagcctgggcagcatggtgaaaccctgtctttaccaaaaataaaaaaattagccgagtgt

SEQ ID NO: 457327 - DNA, 570 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagcca

SEQ ID NO: 457328 - DNA, 824 bp, Homo sapiens
cgccattgtaaagacataccatgattaatttaaccagtccccagttgatgggcacttggtttgtgttcagattttgtgtattagaaaacaaggctacaggctgggagtcactgccgaagtgataagctgtgggtggtgaatgcagagaaggccacaatgtacagcacctaccctgggagtgttcacttggggttcatgttggaacccattttgcttcctccaccattgcacattgaaggagaatgtatttttgcacgcgcttctcattgcccttcatgtacatctgctctagggcaggagtcagcaaactacagcccagagggcatgtctggcccacggcttgtttttgtaaataaagttttattggagccgggtgcggtggctcacaactgtaatccccacactttgggaagctgagccaggcgatcccttattagcctgaccgctgtggcaaaatcctttctctactaaaaatacaaaaactagccgggtgtcgtgctgcacgcttatagtccaagctactcaggaggctgaggcaggagaattgcttgaacccaggaggtggaggttgcagtgagccgagatttttccactgcactccagcctggacgacagagctagactgtctccaaaagaaaaagttgtactgggaccgggcacagtggctcacgcctgtaatcctagcactttgggaggccaaggtgggcggatcacctgaggttgggagttcgagaccagcctggccaacatggagaaatgctgtctctactaaaaatgcaaaattagccgagtgtggtggtacaggcctgtaatcccagttacta

SEQ ID NO: 457329 - DNA, 342 bp, Homo sapiens
ctgcattttaacaaacatatacacaaacacattttttaaatttgctagaaatcttccctcccattttcaagtgtggttaatcaattgaccaaaacccagttttctttctttctttctttctttttttgagctctgtcacccaggctggagtgcagtggcgcaatctcagctcactgcagcctccgcctcccgggttcaggcgattttcttgcctcagcctcccaagtagctgggactacaggcacccaccaccacgcctggataatgttggtatttttagtagagatggggtttctccatgttggccaggctggtctcgaactcctgacctcaggtgatccg

SEQ ID NO: 457330 - DNA, 424 bp, Homo sapiens
tgtttcctgttcattggtgtctagtttacattattatcttggcagttggtggtaaacctaggcaaaagagtgtggactgtgccaagggaactgtggaaatgttaggggaaataaagctttacatctaattagagtacattgtgtgcatgagaaagaaggtggaaaaggtggttgcagcagaaagcaagttggaggtgtagctcagacctgggttctgtgtcttggcccttctgcacctccacgtcctcatctgtgatatgggtacagtgaaggagacagtcttgatatgggcctataacatgcctgatgctgggcagccactcagtagttgtcactgtttttattaatgttgttgcttttattaaaagactttctcagctgggttttgcaagccttcagtgagatggtggtatattagtcagct

SEQ ID NO: 457331 - DNA, 1323 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaaggggcttgcttctgacatgtctgatgagcgcattcctgctgttgctcctggctattacaaggtgtcgctgtggaagactattcctgtacagctgtgtgaacctgcctcgtcacggcttcctctgcagtgctcttgaatatcccggttcctgcttaggccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggccaggctggtctcttaactccttacctcaaatgatccacccacctcggcctcccaaagtgctgggattatagatgtgagccactgcacccagcccttcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacaggatccctggcaaggatgtctcaatgcagaaagttggctaagtgaactgcagtatctaccctggacctaaaagaacttgctaatgttttcaagactacaattcagaggctgtctgatttaatctttgcatttacaaaaacacccttttacgtacattaaatgtggaataaaactaaaaaaaaagtgatg

SEQ ID NO: 457332 - DNA, 1349 bp, Homo sapiens
  misc_feature (3)..(3): n is a, c, g, or t
cgnctaggtacgaggcctgggtggtggatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457333 - DNA, 1384 bp, Homo sapiens
  misc_feature (3)..(3): n is a, c, g, or t
cgnctaggtacgaggcctgggtggttccgcttccggttctgacggacgcttcggccgtaacgatgatcggagacatcctgctgttcgggacgttgctgatgaatgccggggcggtgctgaactttaagctgaaaaagaaggacacgcagggctttggggaggagtccaggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaa

SEQ ID NO: 457334 - DNA, 308 bp, Homo sapiens
gaagaggaagaggaggagaaaagaaaggaaaagaaaagaaaccatcaggtgaattatgaagtgggtggagaccaaactctaaatagtgcttccaggtgcctcgaatgaggagagaagagaataaagttagtctccctgtgtccctggatcccagggactcagctgcctcagggcctttgcatatactgttctctcttcctggaatgcctttcccccagttatctctggctcacctgcccttcttcttcaagcctttgctcacatgtcatgttccctgatcgccctttaaaaactttttttttttgaga

SEQ ID NO: 457335 - DNA, 372 bp, Homo sapiens
gtgagaccactgcttggagggatgccagggctggagagacatctgggatccatctgcttggagatgctgataaaggcagggactcagtgacggagaggccatggagacacactgaaggcatgagtgcagaggtgccaggtgagggaaggttggagaggcacaccagcacacacaaggtcatgagtgccagggggtctggcagatgggacacagggagctgcagacaggtgactgcattccatcaccctgtgaccctagagcaggggcttctggtaagtggagagatggaagccagatttcgcaaaattaggaatggaaaagtttgcctataatgggaagctataggtaagaccttcactggaggggagggta

SEQ ID NO: 457336 - DNA, 822 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagagttcagaaggaacagctggctgccatcttcaagctcatgaaagacaacaaggagacgtttggcgagatgtccgacggcgacgtgcaggagcagctccggctctacgacatgtagactgcgcccacgggatgcacagcggccatgcctgatgctgtccccacccttgccccatgcccttgttctttccagacttctgtaggcctaattttcccttataaacatagatgcaggcgtacattctataggtacttgccgagttcttgcagtgtgtatattactttgcaggaatcaaaattgttttattcagaagacaaagtccctgacccctctggtttctgcttgctggtgaggttccagctgttattgggctctgaggccctctcctgatccaaatctttttttgtttgtttg

SEQ ID NO: 457337 - DNA, 600 bp, Homo sapiens
gcgtgtgtcagacccaaccagctccgatgttctaagtgggttttattttcattttcttcttgttctgaaaagcaaccgcagtcacacaagagagaggagagtcccaactccgccggctgcacacaggctccctctctccccagtgggctaggagcaccttcttcctctttgtcctttcttctcgacagagttcagaaggaacagctggctgccatcttcaagctcatgaaagacaacaaggagacgtttggcgagatgtccgacggcgacgtgcaggagcagctccggctctacgacatgtagactgcgcccacgggatgcacagcggccatgcctgatgctgtccccacccttgccccatgcccttgttctttccagacttctgtaggcctaattttcccttataaacatagatgcaggcgtacattctataggtacttgccgagttcttgcagtgtgtatattactttgcaggaatcaaaattgttttattcagaagacaaagtccctgacccctctggtttctgcttgctggtgaggttccagctgttattgggctctgaggccctctcctgatccaaatctttttttgtttgtttg

SEQ ID NO: 457338 - DNA, 2327 bp, Homo sapiens
  misc_feature (1749)..(1749): n is a, c, g, or t
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaaaaaaaaaaaaaaaaaaaaaaaaaaaaanaaaacacaaagaaaaaaaaaaaaaaaaaaaaaaccaacgaaacaaaaaagataaacaaaacaaacacaaacaaaacgaaacacacaacacacacagaacacagaaacaaagaaagagaaacaaaacagagggggaagacaaaaaaaaaatacggggagaaagaccaaacacgaagaacagcaacaaaagaaagaagaagaacaaaaaaagaagggagacaaaaaacgacagagaagccacgacacggatacaaactaaagagaaacaaagaaggcgacagataaaacaacaccaaatgacgggaacacacgagaacaaacacgacgaaaaaagacgacacgacaaaataacgaagccatgacgggggcacaaaaagacaagacgacaaagacgacaacagagaagaaagaaaaaatagaagagaaaaggtaaagaagacgagaacgagagcagggacagaagacaacagccagacagcatgcacagaacagaagacagagacagagacagaaaccgacagagaagagaaaagggaagacagagcgaggagaacagagaacaaggccgctgggtcacca

SEQ ID NO: 457339 - DNA, 1539 bp, Homo sapiens
gtcctttgttctcaagcttaaagatgccaaaaggaaaagcctttaggaggacggagaaggcttctccttcaaatacagccccgggaagctgaggggaaaccagtacaagaagatgatgaccaaagaggagctggaggaggagcagaggattgagctgacctctgacctcacttccctgtagcaagttccttaggtcctgagccacaaatattcttgcaaatccttttgaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 457340 - DNA, 1414 bp, Homo sapiens
  misc_feature (44)..(44): n is a, c, g, or t
  misc_feature (46)..(46): n is a, c, g, or t
acgataagaatacgaacaacagaaaggtgggatctatttccctncngggaagagcatggaggaaatcaagaggtgctgctgctggtgctgggctgtgctgtccaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 457341 - DNA, 1557 bp, Homo sapiens
gtgggctgccaggttctgtgcgggatcaaggggagctctgcaagctctggccggcttggcggcacagactgtcttgctgcaagcgatgagaagcaaatcagcagtggtttgagaaaccagagtctagcgcagcttctgcaattccaaacattctccttcctcgtccccatttccccctttccttgcccatggtgcaggatggaatgagtaaaataaattatctttttctccccatttctctttacaaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 457342 - DNA, 1711 bp, Homo sapiens
  misc_feature (1385)..(1385): n is a, c, g, or t
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttactcctcatggcttggatctctgtattcagcctttgttcagtccaataaactttgagtagatgatctcaaaaaaaaaaaaaaaaaaaaaaaaaaaaanaaaaaaaaaaaagggggggggggcaaagaattccccgggggggccccaggattagagcgccgtacccagtcctgttctgtgaccaaggggggccccaaattgggggaggcgaaattaaataggcaggggccagggccgcgtggattaaacacacggcggagcagcggacaacacggtccgcggggactcctggggaaggagcaccatacctcggggggggccatagggcgacaacccccgaaggatttaaggcgagagaactctacctctaggggcaaggggcaccacctgcacagtcgggatgaagtcgtccgcagttgtgaatt

SEQ ID NO: 457343 - DNA, 895 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagaggattgagctgacctctgacctcacttccctgtagcaagttccttaggtcctgagccacaaatattcttgcaaatccttttggtaaggacactgatttcttagactagtggtgctccccttctactgcgtgctaacgtgcccccaaacaactgacgcggcctcaacctcccctcctccatcgccttcataaccgattaatacatttcccacctgagcccttctcattcttctcaagcacgaggaatctctggcagaagaggccccgtctgggggcagaggttcctggaggggagttaagtccctgagttcctggagggggcctaatgggccggcaggttggggtgctagcgccccctcgcaaggctgggggaactgtcaccctgggacctcaggcttcggaaatgtggatgtcgtcaccctgcagccttgggtctcaccctgagaagatgaggcagcttctgcacagtacaaccagatactctgag

SEQ ID NO: 457344 - DNA, 384 bp, Homo sapiens
ccccgagtcctcaggtgctgaggatgctgccgcttggcatgaccaggtttgctgcatttatatttcaggattgagctgacctctgacctcacttccctgtagcaagttccttaggtcctgagccacaaatattcttgcaaatccttttggtaaggacactgatttcttagactagtggtgctccccttctactgcgtgctaacgtgcccccaaacaactgacgcggcctcaacctcccctcctccatcgccttcataaccgattaatacatttcccacctgagcccttctcattcttctcaagcacgaggaatctctggcagaagaggccccgtctgggggcagaggttcctggaggggagttaagtccctgagttcctggagg

SEQ ID NO: 457345 - DNA, 507 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggtacgcaccggggccctcgcggccccctccccacccccggggctccggctgccgctgccgttccccgccgagccagggagcggggccgcggcctccagcccaggctgcccccaggaagcgcagaacccgcggcccgcaggaaatgcaggtcccgccatgctaagccgcagccccgcaaactcgccgccctcccccagaaagtgtggcgaggggcgagcccgaaggagtttgtttggaggtgttttgctctcccct

SEQ ID NO: 457346 - DNA, 1802 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagaggattgagctgacctctgacctcacttccctgtagcaagttccttaggtcctgagccacaaatattcttgcaaatccttttgaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 457347 - DNA, 1721 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 457348 - DNA, 1667 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 457349 - DNA, 1069 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacctacctgcgaacctatgatcataggttcgcaggggtgaggtcagcatcttctgtgtctttacagtctaggatcctaatccatgttctccacgacctgaggcttcttggctgtgctgagtttgctgtacccatgttgagaggagcaactaggtcattcttccatcagcaagtacttatgatgagttctcttgtgagttaagtcaaaacccgtatttctaaagttatggatcttctgttccccaaaatgaatggcttgatttacgtggtattactatgtttcactgtcctgcgaacctatgagggacctctagaacgcct

SEQ ID NO: 457350 - DNA, 2477 bp, Homo sapiens
ccgcgcgattccgagggggttaacggcggagccccggccgggcgcggaccggagcgcgtgaggctccggcgcgcaacccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457351 - DNA, 2272 bp, Homo sapiens
ccccctgcgctctcgccatcgccccgcatttactcgctggaggaggggtcacctcattcctagggaggaggaaacagacattgagcggcgacgtgactcagtgttcataaataggacgacgtccctgcattcccaatctgcactattggaagaaaagccaatgtttgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457352 - DNA, 2204 bp, Homo sapiens
  misc_feature (1466)..(1466): n is a, c, g, or t
ggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcntacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgattctcacctgg

SEQ ID NO: 457353 - DNA, 2435 bp, Homo sapiens
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttctaaattct

SEQ ID NO: 457354 - DNA, 2674 bp, Homo sapiens
ccgcgcgattccgagggggttaacggcggagccccggccgggcgcggaccggagcgcgtgaggctccggcgcgcaacccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccggttaaagaagtgctgtggtggccgcctacgtaattggattcattgtggagctctacttgaagttgcactcatctgaactcattcttgaacatataagccactgcccagaacaaacagggctcttcttacagaaagactcctgcgctgtgaatcagtcacagattgtattaaacttcccaacactactcaatttgtcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457355 - DNA, 3535 bp, Homo sapiens
  misc_feature (1466)..(1466): n is a, c, g, or t
ggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcntacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457356 - DNA, 2332 bp, Homo sapiens
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457357 - DNA, 1884 bp, Homo sapiens
caatcgaatggtcacgagcagctggcccagcagagccctgaatgctcttttatgtttgccttttgactcccaaggacttgtctgagtgaccctgcgattattttccctccttaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457358 - DNA, 1442 bp, Homo sapiens
ccggtgtccttgtgcgatcaccacaaactcagtgattggcccaagttcattcccgggtgccatgaacagtaactggtgtgcagcattagacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457359 - DNA, 1527 bp, Homo sapiens
tgtggaggtggctggtcacgacttcttcggaggtggcagccgagatcggggtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457360 - DNA, 721 bp, Homo sapiens
  misc_feature (35)..(35): n is a, c, g, or t
  misc_feature (97)..(97): n is a, c, g, or t
  misc_feature (101)..(101): n is a, c, g, or t
  misc_feature (104)..(104): n is a, c, g, or t
  misc_feature (107)..(107): n is a, c, g, or t
  misc_feature (119)..(119): n is a, c, g, or t
  misc_feature (158)..(158): n is a, c, g, or t
  misc_feature (162)..(162): n is a, c, g, or t
  misc_feature (204)..(204): n is a, c, g, or t
  misc_feature (226)..(226): n is a, c, g, or t
ttagatacactggggaaaagaaaagcggtagagcnaaatatgctagacctggttggtacacggggggggaaaaagttagggcgagggggagcacttnagtnggntantaactcgacctntttaaccaagaggtgggttggaaaaaggcggtggcccgngggngaacgaggacgggtaagtgcagtagcagggtcgaaggggagngtagagcgtggggctgtattanctagatggtgtgtgcatgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttctaaattct

SEQ ID NO: 457361 - DNA, 549 bp, Homo sapiens
ccgctcccaacgcatgtgccgctcccaacgcatgtgccgctcccaacgcatgtgccgctcccaacgcatgtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttctaaattct

SEQ ID NO: 457362 - DNA, 1226 bp, Homo sapiens
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccagatgattggctagagggtgcggcacaaaggaacttgtcagggtgatggagacattctgtatctggattgagcaatgcaagaacctgggtaaagacacagtcatggtaacagctgtatacatctgttgaaaactcatcaaacttatcatatttagaaagggtacattttgcttcatgtaaagtatgcctcaataaagtgtacttgattttaaaatcaggataaaggaaaaaaacattgatcttggataatgggcaggggttggggagaaggtcttaattatcatcatatccttttaaaaacgtttttcaagtgtgtgatgctctgatgacattcttaagacacagcaaggcaaagcagtatcccaaatgagagagtgagcattccaataaatattttctgtaagacactgatatgtctatgactatttgctaaatttaaaaatcaacttggaccatatttactcccttaaagtctaatagacgactaatttcttctatgttcagaacaaatatgttgctactttaagaacagcatacataggtgtggtcggccctctgtgtctaaggcttctgcatctgtggattcaaccaacaatggactgaaaatattcc

SEQ ID NO: 457363 - DNA, 297 bp, Homo sapiens
tcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggtaaggcttctaatataacgtgattttctttagttttcaaagcattatgctaactgggactattaactgaatacttgggagaatgtggctctcttgtgggtttgggggttttgaaagaaatccaaagtctttcgagccttgaaaatcaaaagctgt

SEQ ID NO: 457364 - DNA, 469 bp, Homo sapiens
aaaatccacacaatttagacactttggagggtgaggggcaggtatgagtaatcaataatggtggtggggaggaagaatttatttcaaatctgcagttattgtgcagaataaaatgtggacaacgtgggcgtcacagaatgaaaccggtctttgagagatgccccattaggagagcagctgtcaaaaaaagcagtgctttcagcgcttggctgtgggtccacaaatgctgtcaatgaactatagttgaaggctgctgccaatacaacaccactgtgaaacagaatggtgtatgtaagtgtcatttatttataatttatatgttcacttactttctgaaaggaattacaatggccgtgtgcttaggtaagcttccaggcatgctttctagagcagcaattgtcaggaactcagggtcttactgattgatcttactctaaaaccttttcctctccatataaactaagcgcta

SEQ ID NO: 457365 - DNA, 2386 bp, Homo sapiens
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457366 - DNA, 2161 bp, Homo sapiens
gaactatagttgaaggctgctgccaatacaacaccactgtgaaacagaatggtgtatgccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457367 - DNA, 1194 bp, Homo sapiens
ccgcgcgattccgagggggttaacggcggagccccggccgggcgcggaccggagcgcgtgaggctccggcgcgcaacccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctattgtgccccagtctgtctgccggatgttgggcatcccgggtcgggggtccgcagcttgggtgcttggacgtagtgtgtggccgccgggggttttggcctcgggtcggcgaaccggaggggggcttggggggcccccgtgggggggctc

SEQ ID NO: 457368 - DNA, 2131 bp, Homo sapiens
tgagcagtagatgagatcatcgagtgaaaggcacttccatcagcacctggctcacagtcagtgttcaatgcaggatttttgaaaaccataaaatgttggtggttcctgtcctgtcctctagggtttgggtgaggaagtgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457369 - DNA, 2333 bp, Homo sapiens
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacaga

SEQ ID NO: 457370 - DNA, 2210 bp, Homo sapiens
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgat

SEQ ID NO: 457371 - DNA, 1610 bp, Homo sapiens
  misc_feature (1524)..(1524): n is a, c, g, or t
  misc_feature (1527)..(1528): n is a, c, g, or t
  misc_feature (1533)..(1533): n is a, c, g, or t
  misc_feature (1540)..(1540): n is a, c, g, or t
  misc_feature (1543)..(1543): n is a, c, g, or t
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcagnganntagtngagtcanganacccccccggtgtgtattccacgcgataaaacaattaagaggttgcacggtgaaaaccccccagggg

SEQ ID NO: 457372 - DNA, 796 bp, Homo sapiens
  misc_feature (7)..(7): n is a, c, g, or t
  misc_feature (30)..(30): n is a, c, g, or t
tgagaanaagaaattagggctagtacgagnctgggtgtgaatcggccgagggagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457373 - DNA, 913 bp, Homo sapiens
ctctttctgtcttgatttttctgtgtgtctctctgcgtcttgtctatttgttttctctctttcttctctgtggccctcccctttgtctcttcctttctgttttctcctgtagttcctcctcttctctcccctgattgctcatgagtccccttgatcaggctgtaatacgtgctgtgtgtctcagtggaggttcctgctggggaggagtccgttgtcttgtgcgtgggggcccgaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagttcaagagaccggggatgaagttggtgccgcggtaacagcttcgttctagaactcaggacagggtggcatcggagaaggccggatgatccgaagggtagtgg

SEQ ID NO: 457374 - DNA, 2207 bp, Homo sapiens
  misc_feature (7)..(7): n is a, c, g, or t
  misc_feature (30)..(30): n is a, c, g, or t
tgagaanaagaaattagggctagtacgagnctgggtgtgaatcggccgagggaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457375 - DNA, 1962 bp, Homo sapiens
  misc_feature (7)..(7): n is a, c, g, or t
  misc_feature (30)..(30): n is a, c, g, or t
tgagaanaagaaattagggctagtacgagnctgggtgtgaatcggccgagggagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457376 - DNA, 2200 bp, Homo sapiens
  misc_feature (21)..(21): n is a, c, g, or t
  misc_feature (250)..(250): n is a, c, g, or t
gcatgaaggggcctctaaggntttggtccagacctcgccgggggtttatttaataccgacgcaaaacttcgtctgtgagcggtggatggcgagctacggcgtcagtaggttcgcgtagtggccgtcatgacgagcgacggctggaaggccgcctcgcgagtcgcacgacgatgatgcaccccgagctaggacgagccttacgcgagtttcgagtgactctgatgctgctgttctctcacggtccctgttnagcatgatgctgtggatctcttgatccaagctctcgttaagacttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457377 - DNA, 2984 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaaggcgtccctcaggatctgcacgccccgctttgaggaaagcagtgggattttgctttttgttttggaagccatgttgtgtggtctgtggacctgcttgctttttttgaatgtgagctgctctcaaatctccatcatttgcaccttgcctatttgaaatgttttaaatctaaacagaagacttgtgtattccagggaagctgcgctggttgtgatctggtgagtggaggtcattctgagccttggctgcagtgctgtgaccacgtcggatgtgatatgtctctctcagttcagccgggccatccagagatgtgcttgcgttgctgtccttgtgctggggagcctctttggcctgatcttcacagggacaggggtggggtggggcctgctttggggcccctgggctgggagtgggagctggattagctgtcctgtggggcactgccctgtggggctgccctgtcatgggaaggagtcagaccgttcctggatggtgggggcggcacggttgatctgcgcacagtgttcttggccagctggtgaactttccctgcactgtgcttccctctagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457378 - DNA, 2443 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgacttctgctgattaaccttttaaaaaa

SEQ ID NO: 457379 - DNA, 2875 bp, Homo sapiens
  misc_feature (2701)..(2701): n is a, c, g, or t
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgaaaaaaaaaaaaaaaaaaaaaaaaaaacaaaaaaaaaggggggggggcaaaaattcccccggagggggggccgcaagacttgcggccgctacacccaggcttttccgtgtatcacaaggggggccccctataagggggagcgcgcattatattaaagcgtaggaccaggggcgccggcgtgtttacacaacgcttcggcgaagggggaaacacgcgggaacgctggggagacccctgggggagggggagcccacaattcgcggggggggagccattactgcgggnacaacccaccactacgacggaaattataaaccgcccgaggggagaataattaacactttcacacgcggctcaagtcgggggaacacacacggcggataatacatcgcggctagaactttccggcccacaggggtaagcttcagaactcttttcccgagccgccataacaaccgg

SEQ ID NO: 457380 - DNA, 2747 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgaaacaaaaaaataaaaacacaaacaacaaaaaaaatgaaggcgggggcaggcataaaagaaaattcacccacgaggggggccacaacaattcgaaagcctacacagagaaatgtgagtgcataacaagacgggcccccatgacgaggcgaagaatatataacaacagaacagacggcccgaatacaaacagagagaagcagggacaacaagagaaaccagatgaagcaaaggaagagacacaccaaccaatcggtggggtaacataggggggaacagcagcaactgaaacaaaagcagactaagagcaacatataagacaagcaggaggat

SEQ ID NO: 457381 - DNA, 1882 bp, Homo sapiens
ctctttctgtcttgatttttctgtgtgtctctctgcgtcttgtctatttgttttctctctttcttctctgtggccctcccctttgtctcttcctttctgttttctcctgtagttcctcctcttctctcccctgattgctcatgagtccccttgatcaggctgtaatacgtgctgtgtgtctcagtggaggttcctgctggggaggagtccgttgtcttgtgcgtgggggcccgaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457382 - DNA, 2363 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatggaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457383 - DNA, 2893 bp, Homo sapiens
ctggatcccattgtcctccctaggtttacctgttcaaccattttctgtgcatgtgaccaatctgtggttgctgtgccctgtcacatggccccatccagggctgtagcaccccatgctgggctgtccccttcctccctgaccatgtgctggaggctgcctttcgcctcaagggctgtgatccctgcaccgggctgtccctgggtgtacacctcctcacttgcatgggctctcacagcctgatctgggcctcactgtggggacacctcctcaccccgtgtgggccctgacagcccgtgccaggccactcccctgcagggacacctcctcacccaagcggagtgggcttgtctgggtcaccatggtctgccatcccctgcacacatgtaccctgctcagccccatgctcctgatggagttgtttaggaggggagtgatgtagtacaaagaatgtttttaaagagaactgcagctactgcaaggagaacagcttgcagcagggctcagctggctgtgggagcctgtgtggaagctgtctcagtgactggggagaggcggcagggcaggcccaggccaggaacacacacaacagatggcaagactggcagctgggcttgtagggcacagagagactgggatcaagggaaggctggggtcctggccctgtctccagagctggggaggctgttgaatttgaagtgctattagaaaggccaggcagacatgggtcccagacagtgagaaacttagcactggtgttggagatggcgatttgagagctttctgggaaagtgactagttgtaatagtgagagaggatgagatctcttagggggaagagagaagagaggagagtgggaaggatccacggccgaacagcaggagatggcatttcgtaggtagtgggaagccttgggaattttttgagctgtaatgcagttgatctatcgctgttgaacctagagtctagtcagcttgtctgtctgcttgaacatttccagtgactgggagacattattcgttggacacttgtttgggtattttcccttgtattaaaagctagaaatctgtctgttaatttccattccttggtcttaggcagtggagtgctttgtcataatttccgaccaggtgtccttctgctctgccagaaatcacgcctctcgccatctgttctctgcttaatactcttcaacagtcccgtgtgaccacagagtccaggtctaagctcttttgcctccgtccctgtaggcgtccctcaggatctgcacgccccgctttgaggaaagcagtgggattttgctttttgttttggaagccatgttgtgtggtctgtggacctgcttgctttttttgaatgtgagctgctctcaaatctccatcatttgcaccttgcctatttgaaatgttttaaatctaaacagaagacttgtgtattccagggaagctgcgctggttgtgatctggtgagtggaggtcattctgagccttggctgcagtgctgtgaccacgtcggatgtgatatgtctctctcagttcagccgggccatccagagatgtgcttgcgttgctgtccttgtgctggggagcctctttggcctgatcttcacagggacaggggtggggtggggcctgctttggggcccctgggctgggagtgggagctggattagctgtcctgtggggcactgccctgtggggctgccctgtcatgggaaggagtcagaccgttcctggatggtgggggcggcacggttgatctgcgcacagtgttcttggccagctggtgaactttccctgcactgtgcttccctctagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457384 - DNA, 2732 bp, Homo sapiens
ctggatcccattgtcctccctaggtttacctgttcaaccattttctgtgcatgtgaccaatctgtggttgctgtgccctgtcacatggccccatccagggctgtagcaccccatgctgggctgtccccttcctccctgaccatgtgctggaggctgcctttcgcctcaagggctgtgatccctgcaccgggctgtccctgggtgtacacctcctcacttgcatgggctctcacagcctgatctgggcctcactgtggggacacctcctcaccccgtgtgggccctgacagcccgtgccaggccactcccctgcagggacacctcctcacccaagcggagtgggcttgtctgggtcaccatggtctgccatcccctgcacacatgtaccctgctcagccccatgctcctgatggagttgtttaggaggggagtgatgtagtacaaagaatgtttttaaagagaactgcagctactgcaaggagaacagcttgcagcagggctcagctggctgtgggagcctgtgtggaagctgtctcagtgactggggagaggcggcagggcaggcccaggccaggaacacacacaacagatggcaagactggcagctgggcttgtagggcacagagagactgggatcaagggaaggctggggtcctggccctgtctccagagctggggaggctgttgaatttgaagtgctattagaaaggccaggcagacatgggtcccagacagtgagaaacttagcactggtgttggagatggcgatttgagagctttctgggaaagtgactagttgtaatagtgagagaggatgagatctcttagggggaagagagaagagaggagagtgggaaggatccacggccgaacagcaggagatggcatttcgtaggtagtgggaagccttgggaattttttgagctgtaatgcagttgatctatcgctgttgaacctagagtctagtcagcttgtctgtctgcttgaacatttccagtgactgggagacattattcgttggacacttgtttgggtattttcccttgtattaaaagctagaaatctgtctgttaatttccattccttggtcttaggcagtggagtgctttgtcataatttccgaccaggtgtccttctgctctgccagaaatcacgcctctcgccatctgttctctgcttaatactcttcaacagtcccgtgtgaccacagagtccaggtctaagctcttttgcctccgtccctgtaggcgtccctcaggatctgcacgccccgccagggaagctgcgctggttgtgatctggtgagtggaggtcattctgagccttggctgcagtgctgtgaccacgtcggatgtgatatgtctctctcagttcagccgggccatccagagatgtgcttgcgttgctgtccttgtgctggggagcctctttggcctgatcttcacagggacaggggtggggtggggcctgctttggggcccctgggctgggagtgggagctggattagctgtcctgtggggcactgccctgtggggctgccctgtcatgggaaggagtcagaccgttcctggatggtgggggcggcacggttgatctgcgcacagtgttcttggccagctggtgaactttccctgcactgtgcttccctctagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457385 - DNA, 850 bp, Homo sapiens
cagctcggtcctctcctcccacctctcaggactaacaggtgcatgtggacacttgaaccacgactgtgtcacagctcctcctggaccaggcctggtgcctgagtgtgaagactcctggcctgcgtggcaggggcagctatctgggagggctaaacagcctggaggctgagtctgcagaggaagggggacctgaaagagccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457386 - DNA, 408 bp, Homo sapiens
  misc_feature (19)..(19): n is a, c, g, or t
tgagctcggtcccatgacncggaacacgccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457387 - DNA, 1541 bp, Homo sapiens
ctggatcccattgtcctccctaggtttacctgttcaaccattttctgtgcatgtgaccaatctgtggttgctgtgccctgtcacatggccccatccagggctgtagcaccccatgctgggctgtccccttcctccctgaccatgtgctggaggctgcctttcgcctcaagggctgtgatccctgcaccgggctgtccctgggtgtacacctcctcacttgcatgggctctcacagcctgatctgggcctcactgtggggacacctcctcaccccgtgtgggccctgacagcccgtgccaggccactcccctgcagggacacctcctcacccaagcggagtgggcttgtctgggtcaccatggtctgccatcccctgcacacatgtaccctgctcagccccatgctcctgatggagttgtttaggaggggagtgatgtagtacaaagaatgtttttaaagagaactgcagctactgcaaggagaacagcttgcagcagggctcagctggctgtgggagcctgtgtggaagctgtctcagtgactggggagaggcggcagggcaggcccaggccaggaacacacacaacagatggcaagactggcagctgggcttgtagggcacagagagactgggatcaagggaaggctggggtcctggccctgtctccagagctggggaggctgttgaatttgaagtgctattagaaaggccaggcagacatgggtcccagacagtgagaaacttagcactggtgttggagatggcgatttgagagctttctgggaaagtgactagttgtaatagtgagagaggatgagatctcttagggggaagagagaagagaggagagtgggaaggatccacggccgaacagcaggagatggcatttcgtaggtagtgggaagccttgggaattttttgagctgtaatgcagttgatctatcgctgttgaacctagagtctagtcagcttgtctgtctgcttgaacatttccagtgactgggagacattattcgttggacacttgtttgggtattttcccttgtattaaaagctagaaatctgtctgttaatttccattccttggtcttaggcagtggagtgctttgtcataatttccgaccaggtgtccttctgctctgccagaaatcacgcctctcgccatctgttctctgcttaatactcttcaacagtcctgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457388 - DNA, 608 bp, Homo sapiens
ctgtgtgtctcagtggaggttcctgctggggaggagtccgttgtcttgtgcgtgggggcccgaacataggccctgcagcccagctgcttgggggcattccactctgctggccaccagctgtgactgcaggtcccttagttgctctctgcccagcttcctcatcaaattggggtcatagtagccctgcctgtgggattgttgcgagggtttaaaggcgatcacacctcgagagtgcttagcactcaatccatgttctttctattatttttcaaaacttactactacttttcttttctaaaaggagatgagtagaatgtcatatttctctcaaatagaactaacaaatagaactgaagcctgcctaacacttgcagtagatgttatcaagtcagttggccttagtaaaagaaggaattcctcatccttatagaaaagattctgcctttaatgaaattagtctaaaaaaatcatttaacacctaatactgtttttactataagaaggaataaatcttctgacaaatgacatggagaagtttcagtttttctttttaaatcagttaggttggttaatattttgcaattattgagaagttcctagttcaagtc

SEQ ID NO: 457389 - DNA, 434 bp, Homo sapiens
cttggtcctcccctgacctacttcccctctgttcatactgggccctgtgcacaaaggtttcttctcagcagctgagcctttgttcatgatggtcatagagcactttccatatatatatttggaccaagaccagtttggtgcttggctaaaattttttttctgaaattgaggggctatggttcactctctgcttgggtgaatttttcagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaaggtaactgtgaaaactgttattccaagaaagaaa

SEQ ID NO: 457390 - DNA, 2417 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457391 - DNA, 2445 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagccagggaagctgcgctggttgtgatctgctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457392 - DNA, 1962 bp, Homo sapiens
gccgtggggtgaatcggccgaggctggaattcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457393 - DNA, 2797 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagccagggaagctgcgctggttgtgatctggtgagtggaggtcattctgagccttggctgcagtgctgtgaccacgtcggatgtgatatgtctctctcagttcagccgggccatccagagatgtgcttgcgttgctgtccttgtgctggggagcctctttggcctgatcttcacagggacaggggtggggtggggcctgctttggggcccctgggctgggagtgggagctggattagctgtcctgtggggcactgccctgtggggctgccctgtcatgggaaggagtcagaccgttcctggatggtgggggcggcacggttgatctgcgcacagtgttcttggccagctggtgaactttccctgcactgtgcttccctctagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457394 - DNA, 2632 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaaggcgtccctcaggatctgcacgccccgctttgaggaaagcagtgggattttgctttttgttttggaagccatgttgtgtggtctgtggacctgcttgctttttttgaatgtgagctgctctcaaatctccatcatttgcaccttgcctatttgaaatgttttaaatctaaacagaagacttgtgtattccagggaagctgcgctggttgtgatctgctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457395 - DNA, 2224 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457396 - DNA, 2091 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457397 - DNA, 1331 bp, Homo sapiens
tgtggtgactctagacgatcccgttatcatcccccttcgtcatggccaggatacgtaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457398 - DNA, 986 bp, Homo sapiens
aaccactcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagcctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcga

SEQ ID NO: 457399 - DNA, 1326 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctat

SEQ ID NO: 457400 - DNA, 2089 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttg

SEQ ID NO: 457401 - DNA, 2315 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttctgaactttggatactcttcaaatttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaact

SEQ ID NO: 457402 - DNA, 2331 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttaaaaaaaaaaaaaaaaagaaaaagaaaaaaaaagaaaaaaaaaaaaaaaaaaaaagacaggggggcgagccacaaagaaatcgccccaagggggcccacaacaccaccacggcaaaccgcccaaacacctgacgccacaacagggggcccccacctacacggaggaccacattacaacacgcactgcgcccacgggcccggacaaaaaaacacacctcctaaccagcgggagacacaccccggcgccctcaacaggagcagaccatccgtcgcctgcgcgcacagacagcctccccacgacgactactcacggccggtctcgtaaccacacatcagggtgccgcaacacatcacccgcgacgggcgagacgaacttcaacaaccctcccacgggacaactctcacgcaaccctcccccgccgc

SEQ ID NO: 457403 - DNA, 1641 bp, Homo sapiens
caatttttttcctttaggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaact

SEQ ID NO: 457404 - DNA, 2265 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaact

SEQ ID NO: 457405 - DNA, 1182 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctat

SEQ ID NO: 457406 - DNA, 2121 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaact

SEQ ID NO: 457407 - DNA, 1825 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgcgtctccgcagcgcgcccaactgcatcctcctggccatgttcctcgtccactacgggcatcggttttggcttgtggttaacgggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaact

SEQ ID NO: 457408 - DNA, 722 bp, Homo sapiens
gcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaatagaggaagaacaggcttttgagttcctgtgcagatcacacgatttatgcctccccatgttctctgaggcagaaaggatgtccc

SEQ ID NO: 457409 - DNA, 2159 bp, Homo sapiens
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggtatttacacacacagtgtatctttctgaaattgtatggtgaagttatgggtgatctttactgttcagaatttaggaaagttctctggctgttgcatccaagtaaaattaaaataaaattggttgcaattttaaaatcaagttcttcctatttgctttattcattcttggggctgttttaagaagttgtgtttctggtgctgtagcatgttcaaagtttttaaattaaggcaaaataaacatggtctaatgaattcattgtataatttcagtttatcaaactttgtaggttgttcggaatcctataattgaaaaacagagtaaagatggaaaaccagttattgaatatcaagaggaggagttgttggtaatgtgtcattgtttgtttatttatttatttttttaaatgtattgctgagtatgttgaatgccttacttggtcggatttaaactaggaggcttttgcagaagtttctcggggtatatagcaaaggtttatgtttatcatttacatgagcacaatctttttaaaatgtatatgcacccaatctcactaataccttctactcttcatctatattgaaagccctcctaaagtaaggcttactgattgacaaattagagtttaaacacttctggctgggaacagtggctcacacctgtaatcctagtactttgggaggtcaaggcaggcagattacttgaggtcaggggttcgagaccagcctggccaatatggcggaaccctgtctctactaaaactacaaaaactggccagggatggtggcgcacacctgtcatcccggcttctcaggaggctgaggcaggagaatcgcttgaaccggggacgcaaatgttgcagtgagccaggattgtaccactgcgctccagcctggacaacagagcgagactccatctcaaaaaaaaaaaaaaaaaaaaagaacgcaaacactttttttcagcacgcaactattgtgggatgaagtttataaacattatactgtttggccaagagtcagtgtacctttgccatctatccagtagacattgtttttcccttgaactgagctgtgtgctgtgttttcgcgtctgcaggacaaggtttatagctcggtgctgcggcagtgctacagcatgtacaaggtaagcgtggcgttctttctcaactcagagtccaaccacttacccctatctctaggctccagggttgtttaaagagaagtctataaatgactgcaaagtgactctgtatttgtcttagagaagaaaataatgaggcctttgaaacaggtagtgaggtttatgcctacatttattcagtaagtattgaactcccttctcttttctcagccttatagtaggaatgtgtccccattgatgaaaaagtgtatctatgtgctcaaggaacatacagaatgcagataattttatgatttaaaagtttcagtgaggcagggcacagtggatcacacctgtaatttcagcattctgggaggctaaggtgggaggattgcttgagcccaggaattcaggaccagtctgggcaatatagcaagaccccatctctacaaaaaaattttataaaagttagccaggtatcatggtgcatgcctgtagtcccagctacctgggaggctgaggtgggaggatcgctcgcaccttggaggtcgaggctgcagtgaactgtgattgcaccactgcactctaccctgggcaacagcgagattccatctcaaaaaaaaa

SEQ ID NO: 457410 - DNA, 969 bp, Homo sapiens
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggtaggtacaccccgaggcatggtattaaaagaagaaattaagataataaaaacagcagtgactggattgatgacaggttgtcaaacaggaacttgcagcggggaggatgggtaggaagcatcttcatagatattgtcaaaataaagcagtgattatttaaagcaga

SEQ ID NO: 457411 - DNA, 395 bp, Homo sapiens
cgggccaggtcggaaacggagcaggtcaaaacacccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctccttgagcactgtgatgtccacctcatagtcatgtctcttggcctcttcctctctcaagataaagatgttcagcctaaaagcaaac

SEQ ID NO: 457412 - DNA, 596 bp, Homo sapiens
tgatagttgtctccagatgtagtcccttcgacggtgttctgccaggaacagagaccaaatattcattcctttttatgtcaacgacgcccataggaaattacggcttgtccggaaagcacttggtcctgatgcgttctggcagctacggaagacaggaagagagcgagcagctggggaaggagaggagggacctcgaactgtgcgtcttgattacggcaccgcaggaatgccctgtctctgctgggatgctgagctctgcgggagaaaatgacacaacccacagatttgcaccagagggagaagaaacctaggatgacgaggggtcacagaggccgaatctctgtgaagagtatttcaagaagctgacgcttttcctgactatggagagatcggttcaagtgacagcaggattcctggcggtggcaacacggagtcactgctgatgaaaaggggccttcagtggcctggggaggacagtgccacgtggagcaaaagctaagggacacacaggagaggtcctggagaaggtgagcacgtacacagcccaccaagatgcctagcagcaaaggtgtacatgtacacagccccccaagata

SEQ ID NO: 457413 - DNA, 2006 bp, Homo sapiens
  misc_feature (1857)..(1868): n is a, c, g, or t
  misc_feature (1888)..(1892): n is a, c, g, or t
  misc_feature (1908)..(1912): n is a, c, g, or t
  misc_feature (1928)..(1929): n is a, c, g, or t
  misc_feature (1931)..(1936): n is a, c, g, or t
  misc_feature (1944)..(1944): n is a, c, g, or t
  misc_feature (1958)..(1958): n is a, c, g, or t
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457414 - DNA, 2196 bp, Homo sapiens
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaaggattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctccttgagcactgtgatgtccacctcatagtcatgtctcttggcctcttcctctctcaagataaagatgttcagcctaaaagcaaac

SEQ ID NO: 457415 - DNA, 1912 bp, Homo sapiens
  misc_feature (1763)..(1774): n is a, c, g, or t
  misc_feature (1794)..(1798): n is a, c, g, or t
  misc_feature (1814)..(1818): n is a, c, g, or t
  misc_feature (1834)..(1835): n is a, c, g, or t
  misc_feature (1837)..(1842): n is a, c, g, or t
  misc_feature (1850)..(1850): n is a, c, g, or t
  misc_feature (1864)..(1864): n is a, c, g, or t
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457416 - DNA, 3022 bp, Homo sapiens
  misc_feature (2873)..(2884): n is a, c, g, or t
  misc_feature (2904)..(2908): n is a, c, g, or t
  misc_feature (2924)..(2928): n is a, c, g, or t
  misc_feature (2944)..(2945): n is a, c, g, or t
  misc_feature (2947)..(2952): n is a, c, g, or t
  misc_feature (2960)..(2960): n is a, c, g, or t
  misc_feature (2974)..(2974): n is a, c, g, or t
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggtatttacacacacagtgtatctttctgaaattgtatggtgaagttatgggtgatctttactgttcagaatttaggaaagttctctggctgttgcatccaagtaaaattaaaataaaattggttgcaattttaaaatcaagttcttcctatttgctttattcattcttggggctgttttaagaagttgtgtttctggtgctgtagcatgttcaaagtttttaaattaaggcaaaataaacatggtctaatgaattcattgtataatttcagtttatcaaactttgtaggttgttcggaatcctataattgaaaaacagagtaaagatggaaaaccagttattgaatatcaagaggaggagttgttggtaatgtgtcattgtttgtttatttatttatttttttaaatgtattgctgagtatgttgaatgccttacttggtcggatttaaactaggaggcttttgcagaagtttctcggggtatatagcaaaggtttatgtttatcatttacatgagcacaatctttttaaaatgtatatgcacccaatctcactaataccttctactcttcatctatattgaaagccctcctaaagtaaggcttactgattgacaaattagagtttaaacacttctggctgggaacagtggctcacacctgtaatcctagtactttgggaggtcaaggcaggcagattacttgaggtcaggggttcgagaccagcctggccaatatggcggaaccctgtctctactaaaactacaaaaactggccagggatggtggcgcacacctgtcatcccggcttctcaggaggctgaggcaggagaatcgcttgaaccggggacgcaaatgttgcagtgagccaggattgtaccactgcgctccagcctggacaacagagcgagactccatctcaaaaaaaaaaaaaaaaaaaaagaacgcaaacactttttttcagcacgcaactattgtgggatgaagtttataaacattatactgtttggccaagagtcagtgtacctttgccatctatccagtagacattgtttttcccttgaactgagctgtgtgctgtgttttcgcgtctgcaggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457417 - DNA, 1148 bp, Homo sapiens
  misc_feature (999)..(1010): n is a, c, g, or t
  misc_feature (1030)..(1034): n is a, c, g, or t
  misc_feature (1050)..(1054): n is a, c, g, or t
  misc_feature (1070)..(1071): n is a, c, g, or t
  misc_feature (1073)..(1078): n is a, c, g, or t
  misc_feature (1086)..(1086): n is a, c, g, or t
  misc_feature (1100)..(1100): n is a, c, g, or t
cattctcaacattaaatgtatttgcagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457418 - DNA, 867 bp, Homo sapiens
  misc_feature (718)..(729): n is a, c, g, or t
  misc_feature (749)..(753): n is a, c, g, or t
  misc_feature (769)..(773): n is a, c, g, or t
  misc_feature (789)..(790): n is a, c, g, or t
  misc_feature (792)..(797): n is a, c, g, or t
  misc_feature (805)..(805): n is a, c, g, or t
  misc_feature (819)..(819): n is a, c, g, or t
aaaaaaattttaaaagaagaatctagttgtatccggcccgagtgctactgtcttcgtgacatgttttcacaggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457419 - DNA, 692 bp, Homo sapiens
  misc_feature (543)..(554): n is a, c, g, or t
  misc_feature (574)..(578): n is a, c, g, or t
  misc_feature (594)..(598): n is a, c, g, or t
  misc_feature (614)..(615): n is a, c, g, or t
  misc_feature (617)..(622): n is a, c, g, or t
  misc_feature (630)..(630): n is a, c, g, or t
  misc_feature (644)..(644): n is a, c, g, or t
gcggccgcctactactactaaatcgcggccgcgtcgaccaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457420 - DNA, 834 bp, Homo sapiens
  misc_feature (685)..(696): n is a, c, g, or t
  misc_feature (716)..(720): n is a, c, g, or t
  misc_feature (736)..(740): n is a, c, g, or t
  misc_feature (756)..(757): n is a, c, g, or t
  misc_feature (759)..(764): n is a, c, g, or t
  misc_feature (772)..(772): n is a, c, g, or t
  misc_feature (786)..(786): n is a, c, g, or t
gcgtgaaccaccttcatgggcgccgcttccaaacagacccgggagccctgaagtcaccggttccctcgcgcggcactccctgagccttttaaatgccacgtgcgcccgttccatttcctgttcttggtttggaacgcttattctcacagtctggccgtatgagtaacgaacaattgcattttgaccctcgtcttgcagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457421 - DNA, 520 bp, Homo sapiens
cgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaattaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgc

SEQ ID NO: 457422 - DNA, 705 bp, Homo sapiens
tggaacttccggggggagctttatgttattttgaatcaaaaaaatgcaaacctgattgaagtaaatggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatggtaagtaggatttggtatttcaggagaatttgagaagttgtcttttcattgcattaagaaacatggttaaaaaataggtaaatagaacaaatcatgactgttgagattctaagcaggtgcctctgctccacatttgatccattttctgttccttggaaaactatgacaagaccttcctgtagcacaggaaacttggcaatggcagaaagaaaattattttctacaattctaaaaaaaaaaaaaaatgactttatattaagaaatgtccccctttttttggagacaggttctcactttgtcacacaggctggagtgcagtggtgcaatcatagctcaccacagcccccaact

SEQ ID NO: 457423 - DNA, 475 bp, Homo sapiens
  misc_feature (299)..(299): n is a, c, g, or t
  misc_feature (363)..(363): n is a, c, g, or t
  misc_feature (435)..(435): n is a, c, g, or t
  misc_feature (455)..(455): n is a, c, g, or t
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggagcatggggaagtgattgactgtgtgcaggagctgagccactccgtgaacaagctgtttggtctggcgtctgnagccgttgacagatgcgtcagattcaccaatggcctggggacctgcggcctgttgtcagccctnaaatccctgtttgccaagtatgtgtctgatttcaccagcactctccagtccatacgaaagaagtgcaaactngaccacatttctcccaactncctcttgcaggaagattgga

SEQ ID NO: 457424 - DNA, 2189 bp, Homo sapiens
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaaggattacactggccaccagctccgtgacccaggctggaatgcaatggctcactgcagcctcaacctcctgagctcaagcaatcctcccacctcagcctcccaagaagctagaaccacatgtacacaccaccacggaaattacggcttgtccggaaagcacttggtcctgatgcgttctggcagctacggaagacaggaagagagcgagcagctggggaaggagaggagggacctcgtaagttaccttgcttccagttcgtcatcttccatcttccgctgctgggcctgtgctgtgctacgtaacctgtctgcccttattttctccttgatagcttcttcacgtttatacgcatgaaagagcgtgttcacaaagaagacgtacgtattattgacccacgtgttgaactcttcctctcgatcatccttgggtctctcatatttctctggaatagagtttcatgaagctgaacatgaatacaatcctgctgtcaattgggggtctgcgtgctttttctcgttctagcctccctggggtggg

SEQ ID NO: 457425 - DNA, 2294 bp, Homo sapiens
  misc_feature (2145)..(2156): n is a, c, g, or t
  misc_feature (2176)..(2180): n is a, c, g, or t
  misc_feature (2196)..(2200): n is a, c, g, or t
  misc_feature (2216)..(2217): n is a, c, g, or t
  misc_feature (2219)..(2224): n is a, c, g, or t
  misc_feature (2232)..(2232): n is a, c, g, or t
  misc_feature (2246)..(2246): n is a, c, g, or t
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggtatttacacacacagtgtatctttctgaaattgtatggtgaagttatgggtgatctttactgttcagaatttaggaaagttctctggctgttgcatccaagtaaaattaaaataaaattggttgcaattttaaaatcaagttcttcctatttgctttattcattcttggggctgttttaagaagttgtgtttctggtgctgtagcatgttcaaagtttttaaattaaggcaaaataaacatggtctaatgaattcattgtataatttcagtttatcaaactttgtaggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457426 - DNA, 1849 bp, Homo sapiens
tgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatggtaagtaggatttggtatttcaggagaatttgagaagttgtcttttcattgcattaagaaacatggttaaaaaataggtaaatagaacaaatcatgactgttgagattctaagcaggtgcctctgctccacatttgatccattttctgttccttggaaaactatgacaagaccttcctgtagcacaggaaacttggcaatggcagaaagaaaattattttctacaattctaaaaaaaaaaaaaaatgactttatattaagaaatgtccccctttttttggagacaggttctcactttgtcacacaggctggagtgcagtggtgcaatcatagctcaccacagcccccaact

SEQ ID NO: 457427 - DNA, 1491 bp, Homo sapiens
  misc_feature (1342)..(1353): n is a, c, g, or t
  misc_feature (1373)..(1377): n is a, c, g, or t
  misc_feature (1393)..(1397): n is a, c, g, or t
  misc_feature (1413)..(1414): n is a, c, g, or t
  misc_feature (1416)..(1421): n is a, c, g, or t
  misc_feature (1429)..(1429): n is a, c, g, or t
  misc_feature (1443)..(1443): n is a, c, g, or t
gagatggagtgtctctctgtcgctcaggctggagtgtggagtacagtggcacgatctcagctcactgcagcctccatctcctgggttcaagcaattcccctgcctcagcctctctagtagctgggattgcaggtgcccaccaccagaaccagctaatttttgtagttttagtagagatgaggttttgccatgttggccaggctgcccttgaactcctgacttcaggtgatccacccagctcagcctcccaaagtgctgggattacaggcatgagccaccacgcccagccggcctattctgatatggtgtttgccaaatagcagctggcatcaaaagcaactggtgtgtatgaagtgggagtgtgttctgtttctagattcctgattctccttcacctcgttgaatcaagtcatgtctgttcttgcttttaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaaaaaaaaaaaaaaaaannnnnnnnnnnnaaaaaaaaaaaaaaaaaaannnnnttttttttttttttannnnntttttttttttttttnngnnnnnntttttttntttttttttttttnttttttttttttttttttttaaaattttttttttttttttaatttttt

SEQ ID NO: 457428 - DNA, 1553 bp, Homo sapiens
gagctgtcaaagcgagcaggggtggcgccgggagtgggaacgccacacagtgccaaatccccggctccagctcccgactcccggctcccggctcccggctcccggtgcccaatcccgggccgcagccatgaacggcgaggagcagtactacgcggccacgcagctttacaaggacccatgcgcgttccagcgaggcccggcgccggagttcagcgccagcccccctgcgtgcctgtacatgggccgccagcccccgccgccgccgccgcacccgttccctggcgccctgggcgcgctggagcagggcagccccccggacatctccccgtacgaggtgccccccctcgccgacgaccccgcggtggcgcaccttcaccaccacctcccggctcagctcgcgctcccccacccgcccgccgggcccttcccggagggagccgagccgggcgtcctggaggagcccaaccgcgtccagctgcctttcccatggatgaagtctaccaaagctcacgcgtggaaaggccagtgggcaggcggcgcctacgctgcggagccggaggagaacaagcggacgcgcacggcctacacgcgcgcacagctgctagagctggagaaggagttcctattcaacaagtacatctcacggccgcgccgggtggagctggctgtcatgttgaacttgaccgagagacacatcaagatctggttccaaaaccgccgcatgaagtggaaaaaggaggaggacaagaagcgcggcggcgggacagctgtcgggggtggcggggtcgcggagcctgagcaggactgcgccgtgacctccggcgaggagcttctggcgctgccgccgccgccgccccccggaggtgctgtgccgcccgctgcccccgttgccgcccgagagggccgcctgccgcctggccttagcgcgtcgccacagccctccagcgtcgcgcctcggcggccgcaggaaccacgatgagaggcaggagctgctcctggctgaggggcttcaaccactcgccgaggaggagcagagggcctaggaggaccccgggcgtggaccacccgccctggcagttgaatggggcggcaattgcggggcccaccttagaccgaaggggaaaacccgctctctcaggcgcatgtgccagttggggccccgcgggtagatgccggcaggccttccggaagaaaaagagccattggtttttgtagtattggggccctcttttagtgatactggattggcgttgtttgtggctgttgcgcacatccctgccctcctacagcactccaccttgggacctgtttagagaagccggctcttcaaagacaatggaaactgtaccatacacattggaaggctccctaacacacacagcggggaagctgggccgagtaccttaatctgccataaagccattcttactcgggcgacccctttaagtttagaaataattgaaaggaaatgtttgagttttcaaagatcccgtgaaattgatgccagtggaatacagtgagtcctcctcttcctctggcatcaatttcacccg

SEQ ID NO: 457429 - DNA, 2717 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcataatatcatagcctggacttccctcccttctgtttgtccttctatctcttgggggaaggtttttctcagtggaatgcacaccgataacaagctcccctctccctccttgtgccctgccccgagtggtgacttacagacaactgtcaccacttactgactgcttgcactgctgccagaactggcctaagcacttgacacacttcgtatcatttaatttttacagcattgcaaggtaggtgtttggatcaattaggggttgttgttgttgttgttgttgttgtttgttgttgtaagcaataaaaactggctctaatgaactt

SEQ ID NO: 457430 - DNA, 2399 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcata

SEQ ID NO: 457431 - DNA, 2453 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattgtgagcatcctatcttccccacagtgtgggctcaacaagggaaccccaacagagatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcata

SEQ ID NO: 457432 - DNA, 2347 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggcttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattgtgagcatcctatcttccccacagtgtgggctcaacaagggaaccccaacagagatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcata

SEQ ID NO: 457433 - DNA, 2963 bp, Homo sapiens
  misc_feature (2402)..(2402): n is a, c, g, or t
  misc_feature (2409)..(2409): n is a, c, g, or t
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcataaanaaaacanaaaagagaacaaagacgaaaccgaaaggacaagaagaaaaaaaaaaataaaaaagaaagagaagaagaacaaaacaagaaggggggcggggcccaattagaaaatcacccgggtggcggcgagccagaattagtgcccaacaccccgatgtgcttgtgaaaaacaacagggagtgctgccacaacattaagagagccacgctaaatacaatgagaccgcaacgcgaggactggcgcaccgaatagaaagcaccggcagacgatgagagaaacacaactaaggactgagcagagattctcaagacagacaaccctacaccgaaacagtggcggggcgggagacccaaaacgggggtcgccagcccatatcccaacgacgccgatacaacagaccccagtggggggcaaaaagcatacaccaacgtcgagccgagggcgagtagtcgaagggggatccacacacggagtgcagaaatcccgcgcaggagcggcacgccagcgggtgtgccaacaggggttcataattagtgggaaggaaatctctctggcccgggg

SEQ ID NO: 457434 - DNA, 2589 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcataaaaaaaaaaagaaaaataaaaaaacaaaaaaaaacctgtaatttcaaaagtcctctaggggtgcccacgccccgaaatccccttgtaggggctggaaaacatttaacgggccccagtttaaaaccagcgtgcccggaaaaacccatgggcgtgccgcatcagccacttacggctgcccatctgctcctgg

SEQ ID NO: 457435 - DNA, 2174 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttcccctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcata

SEQ ID NO: 457436 - DNA, 1988 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcata

SEQ ID NO: 457437 - DNA, 1130 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgtctgggctccatcctgcgcccaaagacatccacccagacctcattatttcttgctctatcattctgtttcaataaagacatttggaataaacgagcata

SEQ ID NO: 457438 - DNA, 450 bp, Homo sapiens
tcccctccacaggttaatagttccaactccgtatatcaatgaacccccctcccacatctcctctgaacagtctgagcaagataagctccaggcccactgaccattagctctgttcctaaggatgaatggtcccaaatcccctaagcaatatcccatcccctctgttgagtgatgtcacatccattgacaagtgccctaatctctgaccaatagcccaagagtcaatgttcccacctcttaaagaaccacaaccacaccccagtgcccagtagccaggcatcacccacccatggtccccatccctccccatcttctcaagcctctgtccaactcttgctcccagaacttcattctcatacctctagctctgaagtgtgcagctgggtcttacccagcaactttcccaccaccagagagtctgggtgaccagaagcccttcccactttctag

SEQ ID NO: 457439 - DNA, 304 bp, Homo sapiens
gcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggagtaagtgcccgagccccaggtggcgacgccatcctctcccagcacccccgcccccgcggagcgtctggcattttcct

SEQ ID NO: 457440 - DNA, 2613 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcataatatcatagcctggacttccctcccttctgtttgtccttctatctcttgggggaaggtttttctcagtggaatgcacaccgataacaagctcccctctccctccttgtgccctgccccgagtggtgacttacagacaactgtcaccacttactgactgcttgcactgctgccagaactggcctaagcacttgacacacttcgtatcatttaatttttacagcattgcaaggtaggtgtttggatcaattaggggttgttgttgttgttgttgttgttgtttgttgttgtaagcaataaaaactggctctaatgaactt

SEQ ID NO: 457441 - DNA, 2482 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagtgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcataatatcatagcctggacttccctcccttctgtttgtccttctatctcttgggggaaggtttttctcagtggaatgcacaccgataacaagctcccctctccctccttgtgccctgccccgagtggtgacttacagacaactgtcaccacttactgactgcttgcactgctgccagaactggcctaagcacttgacacacttcgtatcatttaatttttacagcattgcaaggtaggtgtttggatcaattaggggttgttgttgttgttgttgttgttgtttgttgttgtaagcaataaaaactggctctaatgaactt

SEQ ID NO: 457442 - DNA, 2479 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcataaaaatattatatcgtctatcaccgttcttcctattccctaataatactttaggggggggctcggtaccctttgcccttcg

SEQ ID NO: 457443 - DNA, 2256 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcata

SEQ ID NO: 457444 - DNA, 2940 bp, Homo sapiens
  misc_feature (2379)..(2379): n is a, c, g, or t
  misc_feature (2386)..(2386): n is a, c, g, or t
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccctccttgctgctgaggtcatccccaccactgtccggggccgtggcctgggcctgatcatggctctaggggcgcttggaggactgagcggcccggcccagcgcctccacatgggccatggagccttcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcataaanaaaacanaaaagagaacaaagacgaaaccgaaaggacaagaagaaaaaaaaaaataaaaaagaaagagaagaagaacaaaacaagaaggggggcggggcccaattagaaaatcacccgggtggcggcgagccagaattagtgcccaacaccccgatgtgcttgtgaaaaacaacagggagtgctgccacaacattaagagagccacgctaaatacaatgagaccgcaacgcgaggactggcgcaccgaatagaaagcaccggcagacgatgagagaaacacaactaaggactgagcagagattctcaagacagacaaccctacaccgaaacagtggcggggcgggagacccaaaacgggggtcgccagcccatatcccaacgacgccgatacaacagaccccagtggggggcaaaaagcatacaccaacgtcgagccgagggcgagtagtcgaagggggatccacacacggagtgcagaaatcccgcgcaggagcggcacgccagcgggtgtgccaacaggggttcataattagtgggaaggaaatctctctggcccgggg

SEQ ID NO: 457445 - DNA, 1804 bp, Homo sapiens
gggaggggaaagcagcgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggacaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccagtgggatctggtgtgtgacctgggctggcaggtgatcctggagcagatcctcttcatcttgggctttgcctccggctacctgttcctgggttaccccgcagacagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatggctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcaggacctggagaatacctgccctctccctgcaacatcctccttttcctttgcttccctcctcaactaccgcaacatctggaaaaatctgcttatcctgggcttcaccaacttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattatctgaacgaggctgccatcaccactttctctgtccttgggctcttctcctcccaagctgccgccatcctcagcaccgtgcggactccaggaacaaaccaggccagccataaaacaggaagaggatgcagggcgctga

SEQ ID NO: 457446 - DNA, 2175 bp, Homo sapiens
acatattcagcagggttagcttgtccctcccctccctcttcagcttcccagacactgattctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggcaattgtggagaagttaatggaagctggagcccagatcgaattccgtgatatgcttgaatccacagccatccactgggcaagccgtggaggaaacctggatgttttaaaattgttgctgaataaaggagcaaaaattagcgcccgagataagttgctcagcacagcgctgcatgtggcggtgaggactggccactatgagtgcgcggagcatcttatcgcctgtgaggcagacctcaacgccaaagacagagaaggagataccccgttgcatgatgcggtgagactgaaccgctataagatgatccgactcctgattatgtatggcgcggatctcaacatcaagaactgtgctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactctaaacctctaagtccttctataagtgtggtggaaatgtcctatgtgaaaaaaaaagctatataggagggttttttttttccattgttttccaagttttgcagattagaaatgtcccgtacaacagcactcccagtatttaatatgtatacagatcacctggggatctggttaaaatgcagatttctgattcagctgg

SEQ ID NO: 457447 - DNA, 2067 bp, Homo sapiens
acatattcagcagggttagcttgtccctcccctccctcttcagcttcccagacactgattctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcatttataaacggacagctcttcatagagcatgcttggaaggacatttggcaattgtggagaagttaatggaagctggagcccagatcgaattccgtgatatgcttgaatccacagccatccactgggcaagccgtggaggaaacctggatgttttaaaattgttgctgaataaaggagcaaaaattagcgcccgagataagttgctcagcacagcgctgcatgtggcggtgaggactggccactatgagtgcgcggagcatcttatcgcctgtgaggcagacctcaacgccaaagacagagaaggagataccccgttgcatgatgcggtgagactgaaccgctataagatgatccgactcctgattatgtatggcgcggatctcaacatcaagaactgtgctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactctaaacctctaagtccttctataagtgtggtggaaatgtcctatgtgaaaaaaaaagctatataggagggttttttttttccattgttttccaagttttgcagattagaaatgtcccgtacaacagcactcccagtatttaatatgtatacagatcacctggggatctggttaaaatgcagatttctgattcagctgg

SEQ ID NO: 457448 - DNA, 638 bp, Homo sapiens
acatattcagcagggttagcttgtccctcccctccctcttcagcttcccagacactgattctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataacatgggaagatgctgataataaggaatttaagaaaaaagcgggatacaaaagtataaacacatacagtatgagctcaactgtggcttaattttaaggcaaagtctctgtctctgcatagc

SEQ ID NO: 457449 - DNA, 1428 bp, Homo sapiens
tcccacctccgggagtccattccacaggatactggaagatgtatggagacattttataaatttcaaaatgacttgaggtgctcttgacacatagtgtctagggacaagggattttaccaatacctgggatggtcccacgtgaaaaagatttttgctctaaaatggcaaaagcatccctctgagaaacagtgaaggactggtttgagtataaactgcagatcactcctggtggaaaccataaaacactgttataacatatacctaatccttacctcatgaaacacacacagagaatgtgaatttacagatgtcacccacctgaaagtcaactttccttatctcatttgattaggctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactctaaacctctaagtccttctataagtgtggtggaaatgtcctatgtgaaaaaaaaagctatataggagggttttttttttccattgttttccaagttttgcagattagaaatgtcccgtacaacagcactcccagtatttaatatgtatacagatcacctggggatctggttaaaatgcagatttctgattcagctgg

SEQ ID NO: 457450 - DNA, 424 bp, Homo sapiens
cagcagggccaactccagggattccttccacgacagaaaaacatacaagactccttcagccaacatgatggtactgaaagtagaggaactggtatgtaagatgcattaattttataaaatgaaaactggttcatcttggtttttatttgaaaattgaaatgccctttgctttcaggtgtaatgcaagggaactctgaaaatgtcatatatggaaaaaggttgatgtgatgaaacaagtgaaattggaaaaaaaaaatggagctaccagtaatgaattctctgcatatttcctatttaatatcttctcctttggttttattactacagtgtggaatcacgtgtagttatcaaaatgtcttagggaagaagtgttattgaaagaatgtaagcccggaaactttacaataaggcgaaactcatcaaa

SEQ ID NO: 457451 - DNA, 2013 bp, Homo sapiens
acatattcagcagggttagcttgtccctcccctccctcttcagcttcccagacactgattctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggcaattgtggagaagttaatggaagctggagcccagatcgaattccgtgatatgcttgaatccacagccatccactgggcaagccgtggaggaaacctggatgttttaaaattgttgctgaataaaggagcaaaaattagcgcccgagataagttgctcagcacagcgctgcatgtggcggtgaggactggccactatgagtgcgcggagcatcttatcgcctgtgaggcagacctcaacgccaaagacagagaaggagataccccgttgcatgatgcggtgagactgaaccgctataagatgatccgactcctgattatgtatggcgcggatctcaacatcaagaactgtgctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttttttaagggggtaggggtccccaggggaaaaaaaggggggggggtggggaatggggggaggggagccggcaccagcggggcctgtgcccacaatgggactcgccgcccaacaacaggactggaagagaacggcccacgctggaagcgtgcttaaaacggtggtcaaggcggcgggggatcggacactctaatcccccaaagaaaaggggacgcaaaacctcaaaaaaaa

SEQ ID NO: 457452 - DNA, 940 bp, Homo sapiens
acatattcagcagggttagcttgtccctcccctccctcttcagcttcccagacactgattctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggattgttcaaattgtttctacttcttgggcatccattgtgctagtgtgtgtcagtatagtagtaagtatgagtgaaatgatatataacactaaagagctgattaagaatacgattattaaggtgtgatcgtgaaagtgtaggagttcttctataatgggtgaagtggcgtcttggaagcctaagttgaaagg

SEQ ID NO: 457453 - DNA, 1490 bp, Homo sapiens
aaaggagaccgcagaagtaaagaagtggggagtttaggaaagtgcctggtttgggtaatcgaaagcacccagtgatgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttttaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctaaggatttgtgtggatcagatacatacttggcaaatttttgagttttacattcttacagaaaagtccatttaaaagtgatcatttgtaagaccaaaatataaataaaaagtttcaaaaatcta

SEQ ID NO: 457454 - DNA, 532 bp, Homo sapiens
aaaggagaccgcagaagtaaagaagtggggagtttaggaaagtgcctggtttgggtaatcgaaagcacccagtgatgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagtattcatccattgtttctaagcaagaatgccatcactcaaa

SEQ ID NO: 457455 - DNA, 1047 bp, Homo sapiens
  misc_feature (28)..(28): n is a, c, g, or t
agagttagtgtgtaagcaaagaatggtnataagcacccaaaaatttcactgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttttaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctaaggatttgtgtggatcagatacatacttggcaaatttttgagttttacattcttacagaaaagtccatttaaaagtgatcatttgtaagaccaaaatataaataaaaagtttcaaaaatcta

SEQ ID NO: 457456 - DNA, 1440 bp, Homo sapiens
aaaggagaccgcagaagtaaagaagtggggagtttaggaaagtgcctggtttgggtaatcgaaagcacccagtgatgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttttaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctaaggatttgtgtggatcagatacatacttggcaaatttttgagttttacattcttacagaaaagtccatttaaaagtgatcatttgtaagaccaaaatataaataaaaagtttcaaaaatcta

SEQ ID NO: 457457 - DNA, 1115 bp, Homo sapiens
  misc_feature (28)..(28): n is a, c, g, or t
agagttagtgtgtaagcaaagaatggtnataagcacccaaaaatttcactgtatgcaggagctattcttgaagtttgtggatgaaaattgggaaggttccctcaagtccaagagtctcactgtcgcccacactggagtgcagtggcgcaacttcagctcaccgcaacctctgcctcccagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttttaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctaaggatttgtgtggatcagatacatacttggcaaatttttgagttttacattcttacagaaaagtccatttaaaagtgatcatttgtaagaccaaaatataaataaaaagtttcaaaaatcta

SEQ ID NO: 457458 - DNA, 988 bp, Homo sapiens
atttatataatttatgattatgatgattaggttgtattatattcttaattcactgtttgttaggcagtgttatcccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttttaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctaaggatttgtgtggatcagatacatacttggcaaatttttgagttttacattcttacagaaaagtccatttaaaagtgatcatttgtaagaccaaaatataaataaaaagtttcaaaaatcta

SEQ ID NO: 457459 - DNA, 1764 bp, Homo sapiens
aaaggagaccgcagaagtaaagaagtggggagtttaggaaagtgcctggtttgggtaatcgaaagcacccagtgatgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttttaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctaaggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatataaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgctt

SEQ ID NO: 457460 - DNA, 1529 bp, Homo sapiens
aaaggagaccgcagaagtaaagaagtggggagtttaggaaagtgcctggtttgggtaatcgaaagcacccagtgatgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttttaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctaaggatttgtgtggatcagatacatacttggcaaatttttgagttttacattcttacagaaaagtccatttaaaagtgatcatttgtaagaccaaaatataaataaaaagtttcaaaaatctaaaaaacaccacaccacccccccaccccccacccccccca

SEQ ID NO: 457461 - DNA, 505 bp, Homo sapiens
cttcatcatactcctacctgagccatcttgcggtgattcataaaccactgagttggccctacatctgtagcccattagagacagcttggaagacagctacttcaggggagtaagttccaagttgctcttgcctcatccctcttcccatatctccctgctactggtcatagcaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaagctactcagcatagagcgactaaacctttatgctgcttccctgcgagtatgcttcctactgtttgagagcatgcgagagcacctcaagttccaaatggaggtgagtttcttgatgtggaaagaaaagggggaaaaaaaatagggagatatatggcatcttcagtggg

SEQ ID NO: 457462 - DNA, 5559 bp, Homo sapiens
accatgatccgattcgagctcggaccctcgggcattctggacttggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457463 - DNA, 6360 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctctgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457464 - DNA, 3475 bp, Homo sapiens
ctgttcgctgaggatgacgtgcgctttgagagcaacttcagcatcgtctgggcgcctgagtggtaacctggatatgtttcgaaaagactcagttctcaacatactcattcagagcctagactgggagacctttgagcagtattgtgcctggcagctctctctggcccacaatattcccctggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457465 - DNA, 6523 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggtgagtgacaatatgggcagcaattgagtctctcctgcttgacctgtgggaagaattcctggtcctctgcaaggacattcacacaggggccaagcctgtgtccccagctcctctgtgtactttacaggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457466 - DNA, 6539 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactggtatgttctacctcagctctgctgcctgcctcctgtcccacctgttggaaggacttgccctttcccccttggtagctacctccctttaccatactcgccccatgccctctttcctattctcatggtcccactgccacctgcagtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457467 - DNA, 6267 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457468 - DNA, 2641 bp, Homo sapiens
cccgcttccccgctccctgccctaaccccactccaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggtgagtgacaatatgggcagcaattgagtctctcctgcttgacctgtgggaagaattcctggtcctctgcaaggacattcacacaggggccaagcctgtgtccccagctcctctgtgtactttacaggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457469 - DNA, 1584 bp, Homo sapiens
aattctggactcggggcattctggactcggggcaattcttggactctcgcaccctctgggcccactgctggtgccctttactgcaggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457470 - DNA, 5819 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccatgtctgagccttggctccatgaggggggtgccactatgattgcatatctaactggtatgagcactaacatggctctggaaaccgcaagtcctacacttgggaaggggccgaacggcggtccccggttttcccttgggtgggcat

SEQ ID NO: 457471 - DNA, 5148 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatctgcccacaggagcatgtacatatggaaaaacagaacaacagtggactttttatgatataataaatgtcttagtaccagca

SEQ ID NO: 457472 - DNA, 4123 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgcctctccctgcagcattttgggctactggattgaagccacagtcgttgacgtattcccgcggagttcaagccgaccaaggggtttcgcggttattcggggcttccccattgacacctcccttggaaaagaacccaaaatttgcaaaggcccaaacaattcccacttccaaggggttggatttgaaccttggggggccca

SEQ ID NO: 457473 - DNA, 510 bp, Homo sapiens
ctctccacatcacttaatctttcctttttcgctggagcagatcccacccatgagggcacagcagagggcatggagaacatggcagatgctgtcacccatgctcgttttgtgggcacggatcctgccagtgatgaagttgtcctgatgaaaatccttcaggtaagcgagagggaaatagcaattaggctaatggccaggggctggtgccgcagactctacttactctgcccacagcatgaaactgtgttttgactccactggggcttaggggagctactttgtttccagacaagcagctggggtacccaaagtaaaagctttttctaaggaaaatcagtaaaagctttatatgaagtgatgtcaaataccagaagccttaaatacacttgtacctctggccgactgtatttgtgccgtccatctcttgggctcatgggctagggctagaatcagttctgaaatatgtcagggtcataaaaagtgaagaaacaattccaaggacaagcttct

SEQ ID NO: 457474 - DNA, 382 bp, Homo sapiens
attcatccaaatggaagaaacagaagagatcccctcggcccccacgccatatgaccaaagtcacaccaggttcagagctgcccactcccaatggaaccaccttatcatctaacctcactggtgagtgccctggactacttcctctgattagacaaaagaagagctcctttctctcttagggattttgaaattgaagaccaaccaactgaggggctttggtcttggcgctgagaacaaaaagggaaactccaggtcaaatcagagtgtgaccattcagcaactatgcagtgacttaaggttgttctctgacaactttagagaccaatatatgcaaagataagcatgtaatctgggaaacagagaccctagtaccatagagggt

SEQ ID NO: 457475 - DNA, 530 bp, Homo sapiens
aggctggctatcaacaaatgtcagggatggatataaaactggagagaagaattacctagtttctttcttctacttttcccccaatcctaagttagagaagaggaactgttttatgtatcttgagcactcaggaaaggagtaaaaaagagctcgtaagccaattcaattagacatgaagatgggggaagctaaggccattatgatctagccttagttctgtaatcactaagaaccacatcctaggagctttttagctgaccaactgtgggtgggctatggtggactccaggctggccttgtctaatttagaggcaaagtagcttctatacctctagtttttctcatgcagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattg

SEQ ID NO: 457476 - DNA, 347 bp, Homo sapiens
ggacataggatttccagtgggcatgatggatggggttctgtccaagggaatcaggaagggctggccaacctagaaaagggactggggtggggaagtgggttttttcgcttaccttttcctaagtcctatttactgaaaacccaggagttccttaggtggggcttcagtgttgacacaaggggaaaaaacttactggcctgtctctaggagtttcgcaaaaatctgaaaggtgtgaatggaggcaaggactttgagcaagacatcctggaggacatgtaccatgccatcaagtgagtatacatagagaatagtgcagtatctctgttaagaagaagcacattgcttcc

SEQ ID NO: 457477 - DNA, 393 bp, Homo sapiens
ggagtttggggagcatcaggatcaagatgcctgaaggatcctgaccctgctcttgctctcaggtattgcctgcctgtgctgcgatgcccggcgccaggtacggatgcaggcactgacctatctgcagcgagcactacttgtacatgatctgcaaaagctagatgccctggaatgggagtcctgttttaacaaggtgggacttcctactggtcttaagataaagttcaaatcctaagaaaaggaaagccaggcagcctgaagagcccctaatgtgagtcttcagcctgcatcataccttcccttcagctctatgcccatccagttcctggcttccttggggcaaggctgcctagctgaacctcatagggagacattgcacatttacccccacca

SEQ ID NO: 457478 - DNA, 6396 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457479 - DNA, 5504 bp, Homo sapiens
tgtgaatcataactcgagttatggcggtcgtgtggatggtgagggagatgaggaagcggaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457480 - DNA, 5012 bp, Homo sapiens
attctttgtgctagaggaaaagttttccaagtcccctcccatcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457481 - DNA, 2863 bp, Homo sapiens
atctagaggatcctgggaggcaggaactgaaaacaagatgggagagagtggcttagagtgtatacaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457482 - DNA, 6690 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtactgctcaccaccctatacccaccctctctcccatacctgccttttcccgaggagggaagccagggcttctggcaggacctagagatgcactgtaggtgctcacaaccccccagctatggacactaagcaggacctagggacctgagaggattctgaatcttaaatcagagattcctccatctctgatctaagattctcatgcaagataggacaggcttagctacccagcctcagagaggggtccagaggctcctacagtcccctcagctgaagggggctggtgggccataggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457483 - DNA, 6833 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtactgctcaccaccctatacccaccctctctcccatacctgccttttcccgaggagggaagccagggcttctggcaggacctagagatgcactgtaggtgctcacaaccccccagctatggacactaagcaggacctagggacctgagaggattctgaatcttaaatcagagattcctccatctctgatctaagattctcatgcaagataggacaggcttagctacccagcctcagagaggggtccagaggctcctacagtcccctcagctgaagggggctggtgggccataggtcttcctgcagcacctgtctccactgctgtcactctctacctttgcggccctctggctcaccatcttggacttcatggacaagtacatgcacgcaggctccagcgacttactggtatgttctacctcagctctgctgcctgcctcctgtcccacctgttggaaggacttgccctttcccccttggtagctacctccctttaccatactcgccccatgccctctttcctattctcatggtcccactgccacctgcagtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457484 - DNA, 2063 bp, Homo sapiens
tacggctaggtacgaggcccggtgttaatcggccgaggaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457485 - DNA, 6190 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagca

SEQ ID NO: 457486 - DNA, 5704 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccagggtagggggctcagcccagctttatcaaaaagagtctcctgcctgggcacaatggctcacacctctaatcccagcactttgagaggccgaggtgggtggatcacccgagggcaggaatttgagaccagcctgaccaacatagtgaaaccccatgtctacgaaaaatacaaaaattagcctatgtagctgggactacaggtgtgtgccaccacacccagctaagttttgtatttttagtagagacgaggtctcaccatgttggccaggctagtctcaaac

SEQ ID NO: 457487 - DNA, 4999 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacagtatcaggttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcaggagattgtctgcttgtattgttatgcattgcccatcgtacaagtggtgtctgcgtacgctagggctctgctaggcgaggatcgtatactctagacccgaacg

SEQ ID NO: 457488 - DNA, 2374 bp, Homo sapiens
tagttaccacgtcagtgagctgacagggaaggtacccggctctactgcccgtcccggacgactcatcctggcggactgtgcagtcccaccctgacttcagcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatagtgagaggcatttctttctttgatgaacccagtgttctatgcttatcccttctctactctctgagtcgtttttcctgtccccatatcacttcccctgggatgctcccaattctgttccgactggcagctttaggatcacgcagtaacgcaggatgtagagacgcagcacagtcatcattttccctcatctttgtggacagaggcagatcctggtatgacccagggagtacttgacgtggg

SEQ ID NO: 457489 - DNA, 871 bp, Homo sapiens
attaataggaaagatgattgtatagatggtgggctattaactcagatcaggatgagaattgggagtgcctttacatgtgtggtacccaaatgggtggttggatataagagtaacaaaaggactgaaagggttaaaaaagaaagaaaaaaaaaaactccctggttgggagggtgttaagtatcgagtgtttttccaaaccattcctcctctgctcacctacccctaggtgattaaaggagataacttttaaaaaagaaagaattggctcaaaggtactgtaattctaggattatatacctttatataggttcattccctgatccctgtattatcaaggcacagataataataatccccaaccacccccacgccacatcaaaaattgtccctcttgagtctttttcccatttacatcacccattgatctgatttcagccaaatcaaaatgttttgagaaaaagaaaaaaaaagaagggctacttgaggtacttaaccccagtctcccctgggaaaagacctgggcatgccaccctgtacaccagccaggagtgccccatatggtggctgcagcttttgatacccaaagcccacagcagctctgtgaggccccacctcctacttttggggacctaaaatgggagaaatggtggttgagcagctggaaatgatgcagagctggcacacaccttgtgaagctcttctctgcctctttcttcattttttctgtttagaaatcccagggagacaatgagcattatttgacacttaaatgtttttgctcctctgataacccagaccatcaactaggatgctgctaaggaaaatggagggaagcaattaaaagggacactgaggggaacaaaagggaaag

SEQ ID NO: 457490 - DNA, 1008 bp, Homo sapiens
  misc_feature (462)..(462): n is a, c, g, or t
  misc_feature (503)..(503): n is a, c, g, or t
ctcgctgccccctccctgcctcctctggccctcctcagtgcccacgcaacccggttcgaaagagaggatgaccgtattctgcattttagaaaacaggctcttagcttcccccgcccccgtcctcactagagtggagaactgaaagcgaacgctataaagggcgccagtgagaggggctggcctcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggtatatttttattatctgatattttattaaaatatcttaaatggtaagattttttttttctttttctttcctattcccatagtcanattcttaactttggagtcactctcttatgtttgagtagccntacttgctttggggcaaaatattgggggatagttttttggagaaagaaaatctgggatgtttttgtagtttagtaatagcaagaatcatgtctgtttgctttaaaggcccaggaaggactgagatactaatggaggagatcgatagaatgggtgatgaagtatcataaatctaatgtaacactatcttctgtcagtgacctagaactatgatatcccgaggcagaagtctcccaggagatttgatgtgtgggtttagaggagtactttcccaccaaccgtaggcatgaaactatatgggaaaatatatcagagtaaattgaaatactttatagcatgccctcattcattcttacagctgtaaaattaaaatgtatgaatggccattttatgaatgaggaaaacctgaaatttgatgatttggctggacccccagattcatgataatctgtatatgttaaggggttttgtttgaataaaagcacatttctaaatagaaaaaaaaaa

SEQ ID NO: 457491 - DNA, 180 bp, Homo sapiens
atacctcttgtataggggttttatgagtattaaaaataatagatttaagttgatcagtatggtgcttgacattcttctttttcttatttctgatagcctaacccatcctgttccaactggggtgtattatcaatgtagcagaaaagacaaattatgctttgtaatgtttcatttgagtgt

SEQ ID NO: 457492 - DNA, 4327 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggtaagaggcagcaaaccaggcttccatcattgcaaggccagagagatagagttggatattagaagtcggatataggttgcctgttgcaatgatctattttgagttaacttattcatttcttggggattctaataggtatatgcgcagcttatgtagctaacagatgtctgtttttaaaatctgcaggcgattcagaagggagcagtgggaagtaatcagtttgtggatcttgaggcaactaactatgatggtaagcaactgaaactttattagattcagagccacttagggggaaccataaggtctaagggtgctaagtatactaagaaggaaggtaattaaagctaaaatattctgtaggtaaaattagacccaaaaagagacaatattcagattgccttactagttcttgtggagcccatttataggttaagttagaggccatcctcagcatttgtcattatagaaggaccaaaagacctgatgggatgcttgaccactgcttgattatacttttcttctaggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457493 - DNA, 3633 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaacctttttttttt

SEQ ID NO: 457494 - DNA, 3756 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457495 - DNA, 2227 bp, Homo sapiens
gtataaaaaggtacattgtgacaagaggcatatagacaaattaataggaaatttaagaggaataaaagattccatttagcttgggattaagcaaggcattttggagaagggagcattcaaagtgagtctctgaagctgaatcagacattcaggagactgggtgaaaagtgtattctgaggcatagtatctggatttttttttttttttttcctccctcttgcctttgacaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457496 - DNA, 3904 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttttttttttttgggccccccccggccgcctttgggggggccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457497 - DNA, 3510 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttttttttttttttttttgggggggggaggtctcaggggccccggggcggggagtgcggggaggtgatcgcgcgccagtgaaccctcaacctcggggtgtcaggtgatcctcgggg

SEQ ID NO: 457498 - DNA, 1954 bp, Homo sapiens
tgttttactttcttgaactcaaagattattataagagatctgaaataagtttaaaaggagtttagtatttttaaaagtcacctcaaaatcttgagaaatattgtgtgtatttcttcgtatacttacaagttaataggagtagtgtagatggtataagaaaggaatgaaactcagaaggaaatacaccacattggccataagaaataaacctcacaaattttatttgtttctcttccagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457499 - DNA, 2970 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggtaagaggcagcaaaccaggcttccatcattgcaaggccagagagatagagttggatattagaagtcggatataggttgcctgttgcaatgatctattttgagttaacttattcatttcttggggattctaataggtatatgcgcagcttatgtagctaacagatgtctgtttttaaaatctgcaggcgattcagaagggagcagtgggaagtaatcagtttgtggatcttgaggcaactaactatgatggtaagcaactgaaactttattagattcagagccacttagggggaaccataaggtctaagggtgctaagtatactaagaaggaaggtaattaaagctaaaatattctgtaggtaaaattagacccaaaaagagacaatattcagattgccttactagttcttgtggagcccatttataggttaagttagaggccatcctcagcatttgtcattatagaaggaccaaaagacctgatgggatgcttgaccactgcttgattatacttttcttctaggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggtaaattcacagaaaaggtttaagatggggtaggggagaaactggttatatagcaaaagaccttgcttccaagtacagattcaaacttctttcttttttttctgaaattaatggtgtgagtagcaatgtatgggtggttaagaagcccagaatttttttttttttttgagacagagtctcactgtgtcgcccaggctggaatgcagtggtgcgatcttggctcactgcaacctccgactccctggttcaagcgattctcctgcctcagcctgcccagtagctgggactacaggtgcctaccaccacacccagctaattttttgtatttttagtagagacggggtttcaccatgttagccaggatggtctcgatctcctgacctcgtgatctgcccgcctcggcctcccgaagtgctgggattacaggcgtgagccaccgcgcccggccaagaagcccagattttaacagatcatttcatgtgttttcttgatttgctttaaatccatgaattattatccaaaaggtcatttaggtataaaataaatagtctttgaaaggtaaaagaaaatgcttgaaattgatattgtcattttggcttccattttcatacactgagaataaaggtgctttttgtaag

SEQ ID NO: 457500 - DNA, 526 bp, Homo sapiens
ctgtgggtttttccctcagtcatagtttagtttcatattccttgttatgataacattgtatgtttaaaatatcttttttcctctggatatccacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggtaagaggcagcaaaccaggcttccatcattgcaaggccagagagatagagttggatattagaagtcggatataggttgcctgttgcaatgatctattttgagttaacttattcatttcttggggattctaataggtatatgcgcagcttatgtagctaacagatgtctgtttttaaaatctgcaggcgattcagaagggagcagtgggaagtaatcagtttgtggatcttgaggcaactaactatgatggtaagcaactgaaactttattagattcagagcc

SEQ ID NO: 457501 - DNA, 426 bp, Homo sapiens
ctgagagatagagaggcttaatttgggtttacctattggctctgaggatccttgaccaaatttttatgaactttaatttcttagggtacccagtggagaaaggtatcaggcaacttaggacctttgagcagagctcgggactcacaaggccattgattgaccagagcaagttggaaaggttttgcaatgtgctgcttggggactttatacattaggcaacagctatacttttgggattattaacgtttatgtctgtgaagatatttaaccaggaatatgttttgttttcttttgaacagttgagccccatatgggggttggcaggcagcagagaggcccctttcaaggtgttcgggtaaagaactcagtgaaggaactcctgttgcacatccgaagtcataaacagaaggcttctggccaagctgt

SEQ ID NO: 457502 - DNA, 604 bp, Homo sapiens
aatccaatgaacaccacacagttagggaaatcactttttcagtggcaggtggagcaggaagaaagcaaattggcaaatatttcccaagaccagtttctttcaaaggatgcagatggtgacacgtgagtattcttttatctcatgttcttaattaggtaagccacacttgttggactagtgagcatataatttttctagggtataacaaggtataccttagttagtggttggctaaccaagatgactggtgtagatagaaaccgccactcagtgatagctagtatgtcaagaaagggttttccttcaaaaaattttttggctgaacagataatctgttctaaattgataaaaatatctgtatcttcttgattaattgagtttggaagaccagcgtagactatgtctatagaacagaaacagttagatcatgattagggataaactgtgagttggtttgtagattgatcttaatctgtcctgatgtctttgtggccttgggcaagttatttaacctccttaggtctcagttccttgacgtgtaaaatgataatacctcttgtataggggttttatgagtattaaaaataatagatttaagttgatc

SEQ ID NO: 457503 - DNA, 3867 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457504 - DNA, 3982 bp, Homo sapiens
ctcgctgccccctccctgcctcctctggccctcctcagtgcccacgcaacccggttcgaaagagaggatgaccgtattctgcattttagaaaacaggctcttagcttcccccgcccccgtcctcactagagtggagaactgaaagcgaacgctataaagggcgccagtgagaggggctggcctcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggttaacaggaagatctcgagggccctggctgaacttcaccttttggctttcttggcctgatgctgaactctcgaggttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457505 - DNA, 3813 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaatagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457506 - DNA, 3666 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaacctttttttttttttttttttttttttttttttttttttaaaaac

SEQ ID NO: 457507 - DNA, 1976 bp, Homo sapiens
atggccttctgtacaccctctcaaagtttttgagctcctttcatgaaatttcccccttcctgatgtctgataattcatttctttgtcttcaggcttacaatggcaacactgccctccatgttgctgccagcctgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtctta

SEQ ID NO: 457508 - DNA, 1720 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgtgagtattcttttatctcatgttcttaattaggtaagccacacttgttggactagtgagcatataatttttctagggtataacaaggtataccttagttagtggttggctaaccaagatgactggtgtagatagaaaccgccactcagtgatagctagtatgtcaagaaagggttttccttcaaaaaattttttggctgaacagataatctgttctaaattgatatctatagaacagaaacagttagatcatgattagggataaactgtgagttggtttgtagattgatcttaatctgtcctgatgtctttgtggccttgggcaagttatttaa

SEQ ID NO: 457509 - DNA, 260 bp, Homo sapiens
gaatgcaaagttaaccatgcagagaagggtgagggggaagccaggcagagagtatggtgagtgcagaagccctaaggagtgaaagttatcttcattcacttaacaggcattgagagcccaaatatgccagtcagaattccaggtactggggctacagcagaaaaccaaacaagtctctgccctcatggatcttacattagaggtgtaacagaggaggagagactgacaagcaaataggtgaatatgtgatatagcgtcaa

SEQ ID NO: 457510 - DNA, 3797 bp, Homo sapiens
attcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggagattccagaagcttatttcattagagacccccacactttccttcttacaaaggactttattaaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacacccactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattcacc

SEQ ID NO: 457511 - DNA, 4831 bp, Homo sapiens
  misc_feature (1)..(2): n is a, c, g, or t
  misc_feature (5)..(8): n is a, c, g, or t
  misc_feature (15)..(15): n is a, c, g, or t
  misc_feature (17)..(17): n is a, c, g, or t
nnacnnnnctttgtngnaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacacccactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattcacc

SEQ ID NO: 457512 - DNA, 3555 bp, Homo sapiens
  misc_feature (1)..(2): n is a, c, g, or t
  misc_feature (5)..(8): n is a, c, g, or t
  misc_feature (15)..(15): n is a, c, g, or t
  misc_feature (17)..(17): n is a, c, g, or t
nnacnnnnctttgtngnaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtttccgaagtcatcatcatctgatgtagagcctacagcatctaaaaacatgaaatcgagtcctaatgaggttctgcaatttgctgaaacctgagctgctctgccgagccatctggcagggatctggggcaacagcgaccatggggaaacggccctcattgtctattctgcataatccactttggggattgtctttattttatttaaaaggaactaagtagtgaaaaa

SEQ ID NO: 457513 - DNA, 2220 bp, Homo sapiens
  misc_feature (1)..(2): n is a, c, g, or t
  misc_feature (7)..(7): n is a, c, g, or t
  misc_feature (9)..(10): n is a, c, g, or t
  misc_feature (56)..(56): n is a, c, g, or t
nncgctngnnggtgaaggaggagtgccgcctgctcaatgcccctccagtgcctccncggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatctgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctgaagatgagtacaagtggcaaaaaa

SEQ ID NO: 457514 - DNA, 2151 bp, Homo sapiens
  misc_feature (1)..(2): n is a, c, g, or t
  misc_feature (7)..(7): n is a, c, g, or t
  misc_feature (9)..(10): n is a, c, g, or t
  misc_feature (56)..(56): n is a, c, g, or t
nncgctngnnggtgaaggaggagtgccgcctgctcaatgcccctccagtgcctccncggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatctgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagcacagtaggcatactagacacaaaacatcgcccatcgacatacagagcaacccagcgcgccataacaaaggcgtccacccccacggggcaaaaagcccaacggcaggggcatgctcttcgacaccaaaacaagaccccgacacgcaagaaccagggcacccacccagcacgagc

SEQ ID NO: 457515 - DNA, 2619 bp, Homo sapiens
  misc_feature (1)..(2): n is a, c, g, or t
  misc_feature (7)..(7): n is a, c, g, or t
  misc_feature (9)..(10): n is a, c, g, or t
  misc_feature (56)..(56): n is a, c, g, or t
nncgctngnnggtgaaggaggagtgccgcctgctcaatgcccctccagtgcctccncggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggtgggcgagtcctctagccgcccagcccccggtcccctaccctcaaccacacagcccagccaggcctcccgggccctcacagagcctctgagcggtcgagccgcctcccttctgggggctgacacccctgttaagacctaccacagctgccctcctctattcaagccctcacatccccagaagcgctttgctccgtttggagctctcaaccctttttccgggcctgcctacccctcaggcccttcagcggccttgtcttctgggcccagaaccacctcgggtcctgtggctacctctggccctgcgtattccccaggcccagcctcgccaggccaggcctattcagctgctcccccctcctcctgcgccccctcctcctcctcttcttctgaatggcaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatctgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctgaagatgagtacaagtggcaaaaaa

SEQ ID NO: 457516 - DNA, 2007 bp, Homo sapiens
  misc_feature (1)..(2): n is a, c, g, or t
  misc_feature (7)..(7): n is a, c, g, or t
  misc_feature (9)..(10): n is a, c, g, or t
  misc_feature (56)..(56): n is a, c, g, or t
nncgctngnnggtgaaggaggagtgccgcctgctcaatgcccctccagtgcctccncggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatctgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagcacgaatccagcaccagcacgaattccctt

SEQ ID NO: 457517 - DNA, 179 bp, Homo sapiens
tagtcggccctggttagacagaggaggggacagcactgaggagtgagcacagaagacgaagagaaccagaaacaatgccaggacctcggcgccttcaccgagagcatggttgtctttgggtgccccaactgaccacacccccattcccccactccagataaagcttcagttatatctca

SEQ ID NO: 457518 - DNA, 658 bp, Homo sapiens
tatttgaggggttttgagtgagtttcttaatcctgagttctagtttgattgcactgtagtctgagagacagtttgttataatttctgttcttttacatttgccgaggagagctttacttccaactgtgtggtcaattttggaataactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457519 - DNA, 166 bp, Homo sapiens
ttgatgaggaggtggtgattccagtgatagggtgggtgatcttggagctggtctgtgaggagaattgcttcatacaaaagtcggatgacaaggtcaccctggaagaacggctggacaaggcctgtgagccaggagtggactatggtgagtgggtgatgggtggggg

SEQ ID NO: 457520 - DNA, 1535 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457521 - DNA, 1574 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacaggtataccctctcccatctttctctcttctgtgtttctagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457522 - DNA, 1483 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457523 - DNA, 1988 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
  misc_feature (1920)..(1920): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcaaaaaaaaaaaaaaaaaaaaaaactggagactagctcgtgccgaattcggcacgagaactagtctcgagtttttttttttttttttttgtaaatgataaactattttactttatgtctaaggtctttcataatatgaaatagaatgtagatattgcaacaatagcatttttggagacagctacctcctttaccaggaataatctttgcatgtcacatttagagataaagctcaaaatgcaaatccttcccctgagagtgggaaagcattaacaaatgagagtgggaaaagcattaacaaagcattaacacaggtctttacatattcaaaatattaaactaatgctaggattatagacttgattttaagacatggtagttaataganaagttctagattgatttttgctatacattggatatgtgatatatggatgtgatatatatatctactgg

SEQ ID NO: 457524 - DNA, 1575 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcacgtaccagggtaccgagctgattcgtatcatgtcatctac

SEQ ID NO: 457525 - DNA, 1808 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcaatatctcacgtgtctggagttctttgccaagagggagaggctgaaatccccagccgcctcacctgcagctcagctccatcctacttgaaacctcacctgttcccaccgcattttctcctggcgttcgcctgctagtgtgaccctggatgcgaacagacggaccagggcgtgaccgcgcagaaacttcccatcccctccagtatgatctccgggtacctgtacaccatcgcaccaccgcatcaacgttcggtaccggctcgaattgtatcatgc

SEQ ID NO: 457526 - DNA, 1717 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcaccttttctcaagttatctactgtcattgtgtccttacatcctttctaactttatatatctccttccggggcgctctgatcccctttcgccataatctgatcgcttactaatccattccctgcgtcattacacttttaatatggaaatttctgtgcgtcacccaatcacattacttcctcacg

SEQ ID NO: 457527 - DNA, 1593 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggggtgagcagccaacctagggcctggggtctgatggttccaggggcctgagagtcccagaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457528 - DNA, 1675 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccggaagaaggtaaagagtgaagccaccactcgcgtctcgaatcgcgcggacgctgggcctgcgcaggcctgttcacagcagctgcatcccgtcagtgttgaagcccgtggagccctctttaggggtctgctgagagcggatattggagctgcctctctgtctctgtttggagatccttatgagctggatcccattcgacagcagtgaagagcttgtcgtgcaaaccctctttccccacagaggagcgtgcggggaactgtaagaacgg

SEQ ID NO: 457529 - DNA, 1619 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggggtgagcagccaacctagggcctggggtctgatggttccaggggcctgagagtcccagaggaaagctgtacccggttctaccatccggaaaaggaggatggaaagctgaacaagctctgccgtgatgaactgtgccgctgtgctgaggggtgagttccctggagccgggaacagagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457530 - DNA, 1619 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggtcaggctcagcacgctgcctcccgtggctcttccctggcttcctccccacgactcagcttcttccctctcccctccactccaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457531 - DNA, 1481 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcataccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457532 - DNA, 1406 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggtggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457533 - DNA, 1748 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggtcaggctcagcacgctgcctcccgtggctcttccctggcttcctccccacgactcagcttcttccctctcccctccactccaggctcggatgaggtgcaggttggacagcagcgcacgttcatcagccccatcaagtgcagagaagccctgaagctggaggagaagaaacactacctcatgtggggtctctcctccgatttctggggagagaagcccaaagtgagtgctttccctgcgcgtgcgcgcgaccgcccgactgccccgcccatgccacgcccacaccattgtcacgcccctgcgccacgcccacaccacgccccttcctgacctgccattcttccctccagcctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457534 - DNA, 2014 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
  misc_feature (1946)..(1946): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggggtgagttccctggagccgggaacagagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcaaaaaaaaaaaaaaaaaaaaaaactggagactagctcgtgccgaattcggcacgagaactagtctcgagtttttttttttttttttttgtaaatgataaactattttactttatgtctaaggtctttcataatatgaaatagaatgtagatattgcaacaatagcatttttggagacagctacctcctttaccaggaataatctttgcatgtcacatttagagataaagctcaaaatgcaaatccttcccctgagagtgggaaagcattaacaaatgagagtgggaaaagcattaacaaagcattaacacaggtctttacatattcaaaatattaaactaatgctaggattatagacttgattttaagacatggtagttaataganaagttctagattgatttttgctatacattggatatgtgatatatggatgtgatatatatatctactgg

SEQ ID NO: 457535 - DNA, 1302 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggtggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaaaactttagctacatcatcgggatagacacttggctggtgaatatacctatgcggaggttagaacatcgcaacgcctgagtggaac

SEQ ID NO: 457536 - DNA, 996 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
  misc_feature (963)..(963): n is a, c, g, or t
  misc_feature (980)..(980): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggtacgagagtcncaacctgtcgacagtcnggtccacctcgatcta

SEQ ID NO: 457537 - DNA, 820 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgtgatgaattccttgcaggatcgctacggttcctactgatccgagctctgtg

SEQ ID NO: 457538 - DNA, 1182 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
  misc_feature (1087)..(1087): n is a, c, g, or t
  misc_feature (1111)..(1111): n is a, c, g, or t
  misc_feature (1150)..(1150): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaatgcctcccaggttcaagacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcactggctttttctcttcttgcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcgtgcttctggggaaccggcctcctttgtccctgtaggttgtcactgcctgtctagtcttctgcactttccagggcttatgtgaagtggggcanctttctcaaaggaagacccatccnatgtccaccagttgtctcctgacaaaaaaccatgccatnatgaactaagggtcctctggggctggaaggat

SEQ ID NO: 457539 - DNA, 683 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggcaagtgggcccacagcccctaggcacatgcatccctgtctcctgcggcttcccactggcctcctagagaagacactgaggcccagcgaggcagttcttcattcccacgagccagtgtgattgcagtggagttgagaatcagtttttattacttgcaaacccatctataggttctagaatacaatctgggtactccaagctgtgtgttgagccttcttcttgccccaggtgtctagatcatgttctcagggcccaggttcaggtctaagcctctctctccacctggtgggctctagaccaggttcccagttctatctcacaatcttaccctgtcttgctggtgggttctagaccatgttcccagttctaccaggctc

SEQ ID NO: 457540 - DNA, 382 bp, Homo sapiens
ctgagccctcctctcccttctcagattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggactcgtattacaattgtcgaccggccgcgaatttagtagtagtagtcgacc

SEQ ID NO: 457541 - DNA, 1049 bp, Homo sapiens
  misc_feature (1)..(2): n is a, c, g, or t
  misc_feature (9)..(9): n is a, c, g, or t
nnttccggnacgaggggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457542 - DNA, 1019 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457543 - DNA, 1856 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
  misc_feature (1757)..(1757): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcaaaaaaaaaaagcttcaaggttacttcgcggagctggaacgctggccgcgcaggccctgagggctcgcggccccagtggcgcggccgcgatgcgctccatggcatctggaggtgggtgttcccactgatgaagagcacgcgactgggttggagagggagatcatgctggctgcaagaagggctggaccctacatgtactggcccaaagggagctcaggcacanggaagacctatttagtccctcatctccacagagatataggctgctctggagacatacaccgcgtctggtttgctgccgcgaggccacatgcccgctggg

SEQ ID NO: 457544 - DNA, 1770 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcaaaaaaagaaaacaaaagaaaaactttgtgggcggccggcccgagaaaaagtttaaacatctggtgggggggccccaagggtagtgaacgggcagggtccaagagacaccgggcgtaattgggtgtttcaccaaaaggcggggcgggtgtgaaaccacgggctggggtgggctcagggcaggcgaacccccgcgggggaaagaagggaaggaagggggggagagaaccatgggcga

SEQ ID NO: 457545 - DNA, 1618 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
  misc_feature (1558)..(1558): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctcactcaaaagggcaggctcaaaaantgggaaagagcttaaaaaagggaagaggttgacctacccgggttttttttttttttcctg

SEQ ID NO: 457546 - DNA, 1484 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457547 - DNA, 1471 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457548 - DNA, 1664 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaaagtgagtgctttccctgcgcgtgcgcgcgaccgcccgactgccccgcccatgccacgcccacaccattgtcacgcccctgcgccacgcccacaccacgccccttcctgacctgccattcttccctccagcctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457549 - DNA, 1464 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagcccctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457550 - DNA, 1298 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgagctgcgtctgctgaggagagctgcgtctgctgaggagagctgcgttactgaggagggctgcgtctgctgaggggagct

SEQ ID NO: 457551 - DNA, 1245 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatcagctgcgtctctgaaaaggggtagga

SEQ ID NO: 457552 - DNA, 1091 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggtcgtattacaattgtcgaccggccgcgaatttagtagtagtagtcgacc

SEQ ID NO: 457553 - DNA, 855 bp, Homo sapiens
  misc_feature (1)..(2): n is a, c, g, or t
  misc_feature (9)..(9): n is a, c, g, or t
nnttccggnacgaggggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcacccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 457554 - DNA, 823 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaagaagctaggtcaccggggttcatcttggccatccctctatctctagcaagaattcttgcaaataatatccatgatattcagtactttccaagtacactgtgtatctgatactgttctaagtatccaccatgaggtagacaacacagacagt

SEQ ID NO: 457555 - DNA, 567 bp, Homo sapiens
  misc_feature (53)..(53): n is a, c, g, or t
  misc_feature (55)..(55): n is a, c, g, or t
  misc_feature (57)..(58): n is a, c, g, or t
  misc_feature (95)..(95): n is a, c, g, or t
taactgagaaaggcagcacttgcgggggacatgacaagcaagccaagatcgantnanngtaaattgacctcaggtcaccataaaccagcaccggnaacagaattgaggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtaaggaacagaaacccacacctgcctggcccatgcccctct

SEQ ID NO: 457556 - DNA, 2438 bp, Homo sapiens
ctgaccaattacagcttgcatggtccccgtgtccctgctgcgctgagagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccacaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccggggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatagccccagtcgtcatcacccttgtaagtaaatgactaagaaaactaccaagtggacagaatggtttctacatgtccgttggttttccaaaaaggaaagaagaaaatttttagaaaatttttaaacaaggaatacaccacactgaaggtgtgtgtggtaggatagttcccttcccccacctgtctcccccaaagccagttttttaatggacttaaagcaaaccaaataaccacgtacttttttctgtatattatgaaaatgtgaacacattttaaggaaaaagaa

SEQ ID NO: 457557 - DNA, 1537 bp, Homo sapiens
ctgaccaattacagcttgcatggtccccgtgtccctgctgcgctgagagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccacaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccggggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcagacacaccatcctgagaagccactttttcctaccacaggagcccaagagaaca

SEQ ID NO: 457558 - DNA, 3240 bp, Homo sapiens
agtctttgtggtgatgtcattgccatgagcgagccgggccgttcgttactctgctgtgctgcctcagacgcggagggctgcgtgcagtgggagcgggctccaggagcccgagcctccagccgtcctcagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgactctt

SEQ ID NO: 457559 - DNA, 2455 bp, Homo sapiens
agtctttgtggtgatgtcattgccatgagcgagccgggccgttcgttactctgctgtgctgcctcagacgcggagggctgcgtgcagtgggagcgggctccaggagcccgagcctccagccgtcctcagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaaggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgactctt

SEQ ID NO: 457560 - DNA, 3333 bp, Homo sapiens
agagggaggcggggcgcgccgcgccgcgtacggccccacgcaaaggcccgcgggcaccgcgccgcccccacgcgctcgcaccggcgggcaggtgagcaggcagcgccgcgcgctagcagctggcccccgtagacgccccagccgccgcctccgcctccgcctccgccggcgcatcgcggacgcccagcaggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgactctt

SEQ ID NO: 457561 - DNA, 2166 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagatgccaaggtaattgcagccctcattcatttcacaagacgagcaatcactgatttataaatgcttaactatagaatggcttatgactacccaaaacagtgccccatcaacaaatggggaaaattgccttttgagctcaggaataatttataaattggggactaccttttagttctttagcatattctatttcttattgttttatataatttttaaatcatttgcttcctccttatgtttaacagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgcaatgtttgaatataatgtggaggtgtttacctgagggcctctctatctccccgaattc

SEQ ID NO: 457562 - DNA, 1474 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggtgtgtttagtacaatttaaagcttagataattttaagcattttaaaatgttttctaatcacttcctttgctttggtaaattgctttgttcttaaatattccatattacaagttgcctttttttttttaatataaattagaaatgttcggctgggcacagtggctcacatctgtaatcccagcactttgggaggccgaggcacatggatcgcttgaggtcagaagttcaagaccagcctgaccaacatggagaaaccccgtctccagtaaaaatggaaaaattaactgggcgtggtggcgcatgcctgtaatcccagctactcgggaggctgaggcaggagaatcgcttgaacccggtaggtggaggttgcagtgagccgagatagtgccattgcactcccgcctgggcaacaagagcgaaactctgtctca

SEQ ID NO: 457563 - DNA, 2876 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagaggatagaattttgtggcaatagaatcggtagtttaaaagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactgtatgtattagcttttaaggagaaaatactttttaaagattccagcaaactacaagagtattgaaattaacaaaatatgtcaaatatgtatactttttagtttacagttttccaactaaaaatataagaatacagacctacgtatgtacttttttatttattcaactaatatttattgaatacctgtgtaaaaagcacgtatttgtagtttgtgtttggcaaaaagaatgagagatgcaaattggtttgttttactaatctaaagcaactttgttgaacttgcacataatttctaaagattgatggttatctttggagtttagtatggtagccatgtctcctattagcagcattaagcttacctacagcttacatttctaattgtctgtaaatcctatattgtgatataatagtttaacacatttttgtagctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457564 - DNA, 2789 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaaaaaaaaaaaaaaaaaaaaaaaaaaaaaaaaaaaaaaaaaaaaaaaaaaaaaaaaaaaaaaaaaaaaaggaaagcaaaaaagaacagaaaccaagagagacggaagcataacggagaaacgaaggacgagaacacaaacagcgagcggaacacggcagtccacagatgacgcgggagggagccaggagaagaaacaccaccaggcgcggtcgcgacggcagaagcaagccaaaagacacagaagccacaggcatgaggaaaagagatgagacgcagaacgcaatgctagacgggggtaaagaacaggtcgatcgggacccaagaccagccgagacgcagcagaagaagagcacagagagagggcgaccgcaccaaaaagtagg

SEQ ID NO: 457565 - DNA, 2801 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaattttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactgtatgtattagcttttaaggagaaaatactttttaaagattccagcaaactacaagagtattgaaattaacaaaatatgtcaaatatgtatactttttagtttacagttttccaactaaaaatataagaatacagacctacgtatgtacttttttatttattcaactaatatttattgaatacctgtgtaaaaagcacgtatttgtagtttgtgtttggcaaaaagaatgagagatgcaaattggtttgttttactaatctaaagcaactttgttgaacttgcacataatttctaaagattgatggttatctttggagtttagtatggtagccatgtctcctattagcagcattaagcttacctacagcttacatttctaattgtctgtaaatcctatattgtgatataatagtttaacacatttttgtagctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457566 - DNA, 1320 bp, Homo sapiens
aaaacatattattatatgaaaatatgaagatgcttctcccccttaattatgcaagattttaaaaagagactttaggccaggcatgtggcttatacctgtaatcccagcactttggaaggctgaggcgggcatatcacttgagttctagaccagcctggccagttttttaggcttaaatcttaattccagaatcctatgtagaattgttattttattgcggtgtttggtcaagctcatagcttctgatgtcttcatacagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457567 - DNA, 1187 bp, Homo sapiens
taaaaatgttgcacagagatcccctgttccctttaccaattttctcccatggtaatatcttgcaaaattatggtacaataccaaaactaggatattgacattgatacaatccatcaatcttcttcaaactttcccagttttctctgtacttatttgtgtgttagttctatccaattgtatcctgagtgtgggttcatgtatcgaccatcatagtcaagatacagagcagttccatcaccaggagaatttgtcctgttatccttttatgaccacaccctcttccgtcttgccccttccccacatctctaacccctgacaaccactcatctgttctccatttgtgtactttggtcatttcagaaatgttatataaatggggccaggcatggtggctcatgcccgtggtcccaaagtgctaggattacaggcgtgagccaccatgcccggcctgagccacacattttatgatggggcttctattttgactattctttctgtctcttttcatatccactctgtcttaaatgaacattcagaactagggtaccaatgttttctttaatgtttcagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457568 - DNA, 830 bp, Homo sapiens
caggctggtcttgaactcctgacctcagatgattcaccctcctcagcctcccaaagtgctaggattacaggcgtgagccaccatgcccggcctgagccacacattttatgatggggcttctattttgactattctttctgtctcttttcatatccactctgtcttaaatgaacattcagaactagggtaccaatgttttctttaatgtttcagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457569 - DNA, 754 bp, Homo sapiens
ggattacaggagtgaaccacccgcctggcctgaattgtatactttaaattggtgaattttaaggatgttagacatatccactctgtcttaaatgaacattcagaactagggtaccaatgttttctttaatgtttcagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457570 - DNA, 726 bp, Homo sapiens
gcagggctttcccctgtggagtctgtcagactgcattaatagccaggtaattgccatatgttctaaggcttgagaatactaaagttttgattttaacttttgaaaatgctatctttattaaattaggccacatgcagaaattactcatatttttctactaaatttctttctggtttacaaccttgttcctctcccttttttctttctttttttaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457571 - DNA, 401 bp, Homo sapiens
cagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaattgtgttctagtcatatttaacttcattatgaactagtaaaaatacttaatggtcagaaatccctaaggagttagtt

SEQ ID NO: 457572 - DNA, 640 bp, Homo sapiens
gtagaggtggtcaaatattttaaaacatatactactcagcaatttttaaatgacctttctttattatagccctttgaatcctaagataggttgattttgtatcaattcatcagagtgtattctctcacctaaatagttctgaagagtcaggaacaatcctttttattctgtttttcctttcctagatgccaaggtaattgcagccctcattcatttcacaagacgagcaatcactgatttataaatgcttaactatagaatggcttatgactacccaaaacagtgccccatcaacaaatggggaaaattgccttttgagctcaggaataatttataaattggggactaccttttagttctttagcatattctatttcttattgttttatataatttttaaatcatttgcttcctccttatgtttaacagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattg

SEQ ID NO: 457573 - DNA, 2407 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457574 - DNA, 1922 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgcaatgtttgaatataatgtggaggtgtttacctgagggcctctctatctccccgaattc

SEQ ID NO: 457575 - DNA, 2838 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactgtatgtattagcttttaaggagaaaatactttttaaagattccagcaaactacaagagtattgaaattaacaaaatatgtcaaatatgtatactttttagtttacagttttccaactaaaaatataagaatacagacctacgtatgtacttttttatttattcaactaatatttattgaatacctgtgtaaaaagcacgtatttgtagtttgtgtttggcaaaaagaatgagagatgcaaattggtttgttttactaatctaaagcaactttgttgaacttgcacataatttctaaagattgatggttatctttggagtttagtatggtagccatgtctcctattagcagcattaagcttacctacagcttacatttctaattgtctgtaaatcctatattgtgatataatagtttaacacatttttgtagctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457576 - DNA, 2445 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagaggatagaattttgtggcaatagaatcggtagtttaaaagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457577 - DNA, 2797 bp, Homo sapiens
gccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagaggatagaattttgtggcaatagaatcggtagtttaaaagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactgtatgtattagcttttaaggagaaaatactttttaaagattccagcaaactacaagagtattgaaattaacaaaatatgtcaaatatgtatactttttagtttacagttttccaactaaaaatataagaatacagacctacgtatgtacttttttatttattcaactaatatttattgaatacctgtgtaaaaagcacgtatttgtagtttgtgtttggcaaaaagaatgagagatgcaaattggtttgttttactaatctaaagcaactttgttgaacttgcacataatttctaaagattgatggttatctttggagtttagtatggtagccatgtctcctattagcagcattaagcttacctacagcttacatttctaattgtctgtaaatcctatattgtgatataatagtttaacacatttttgtagctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 457578 - DNA, 4831 bp, Homo sapiens
gggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggagagtttgatgtgtgtcaggtgcttagaacagggcctgatatataatcagcccatgatgagctattactgttatcatgatctgattgtgtgaatagatggtggatgtgtggacagagtgatcggggttcccccaggggcttccagatttagaggcctagtgctatgtggcttgaggaaagctagcttccagagcaggtatctgagctgaactttaagaggagaaaaagagtgagtcagatgaagagggtgactgagggaagggaagaacagacagctgaaccagtgtggccaaaggcctgaaagtaggatttggtgtggctactgcaggggagcagagaacattacctgaactgaggcgggctagggaagaaacagaatgtgtcttatatcctggctattccttcaggttgacagttgggggagccaagccctaatttgaccagggggttggtgtatggacagctcagttggggaagagacagggccctgaatctcatctcccatctgtgtctagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457579 - DNA, 2582 bp, Homo sapiens
gggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457580 - DNA, 1152 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcaggttcgtgaaggaatggggtctgggctgggcttagagggtctgggaatggggcttaggagagtagaaggggcggtgattggttggaaagggcaggccctaagacggactgtgtgagcccgggggctcattgctccgtgaaagggcaagaccagggaaagagaatcgtgtaaaaggggtggagtctagcgggccgggcggggccgggtagaatggccacctgagtggagggagaaggcctgagagaggcggagtttggaaggctgtggagaatcagatcgcaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggag

SEQ ID NO: 457581 - DNA, 435 bp, Homo sapiens
ggtatgcactctcttattatcatcattattattattccctggtcatgtctggtcctttcctgatcccccttcacaactccttgccccagggtggctacgcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggat

SEQ ID NO: 457582 - DNA, 4073 bp, Homo sapiens
accgaaggcggctagggactggctgaagaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457583 - DNA, 4127 bp, Homo sapiens
tcgcgtccccacaggtcgccagaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457584 - DNA, 4113 bp, Homo sapiens
gtgcatgtatctcctgctgcataattagcctaagaccaacattgccccagtgcagtggctcatgcctgtaatccctacactttgttcggttgagcggagatctccgctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457585 - DNA, 4708 bp, Homo sapiens
gggcagggggtggagctggttgaaggaacggggcagtcccctgaggagcggggctggttgaaacgctaggggcgggatctggcggagtggaagaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggagagtttgatgtgtgtcaggtgcttagaacagggcctgatatataatcagcccatgatgagctattactgttatcatgatctgattgtgtgaatagatggtggatgtgtggacagagtgatcggggttcccccaggggcttccagatttagaggcctagtgctatgtggcttgaggaaagctagcttccagagcaggtatctgagctgaactttaagaggagaaaaagagtgagtcagatgaagagggtgactgagggaagggaagaacagacagctgaaccagtgtggccaaaggcctgaaagtaggatttggtgtggctactgcaggggagcagagaacattacctgaactgaggcgggctagggaagaaacagaatgtgtcttatatcctggctattccttcaggttgacagttgggggagccaagccctaatttgaccagggggttggtgtatggacagctcagttggggaagagacagggccctgaatctcatctcccatctgtgtctagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457586 - DNA, 4139 bp, Homo sapiens
  misc_feature (4057)..(4058): n is a, c, g, or t
  misc_feature (4061)..(4064): n is a, c, g, or t
  misc_feature (4076)..(4076): n is a, c, g, or t
  misc_feature (4126)..(4126): n is a, c, g, or t
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccnnaannnnatttcctttttnaggtgcttttttttttcttttttttttttttttttttttttttttttctnttttttggttctt

SEQ ID NO: 457587 - DNA, 4112 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtctcagtggccccaagagggagctgatatcatgaggataacattggcgggaggggagttaactggcaggcatggcaaggttgcatatgtaataaagtacaagctgttaaaaaa

SEQ ID NO: 457588 - DNA, 3153 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacgggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457589 - DNA, 2963 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457590 - DNA, 1978 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggagagtttgatgtgtgtcaggtgcttagaacagggcctgatatataatcagcccatgatgagctattactgttatcatgatctgattgtgtgaatagatggtggatgtgtggacagagtgatcggggttcccccaggggcttccagatttagaggcctagtgctatgtggcttgaggaaagctagcttccagagcaggtatctgagctgaactttaagaggagaaaaagagtgagtcagatgaagagggtgactgagggaagggaagaacagacagctgaaccagtgtggccaaaggcctgaaagtaggatttggtgtggctactgcaggggagcagagaacattacctgaactgaggcgggctagggaagaaacagaatgtgtcttatatcctggctattccttcaggttgacagttgggggagccaagccctaatttgaccagggggttggtgtatggacagctcagttggggaagagacagggccctgaatctcatctcccatctgtgtctagcctagaatatattgatctgatggaaacaacccagtacatgaatgagggagaactccgtgtcctagcagacacctacgactcagtttatctgcatccggtatggatgagaactctgcgggcagggaatggtggcaatcttggggtccccatccctatgcccaccccaccctgggggaagcagctgagtggatagggctgttctctcccttactccctttctggctccccactgtctctccagaactcatactcctgtgcctgcctggcctcaggctctgtcctcaggctggtggatgcggtcctgggggctgagatccggaatggcatggccatcattaggtaggactctacagcatttgactttttacattgttttaaagtccttccttcaagtgtaaaatgtattgatatgggtaatatattcatgtgattcaagaatccaaaggtaaaaaagagaatataattaaaaatctgtctcccatccttgtcacccagacacctgcctcctctcatgggaggtagtcattggaaccactgactcatgtgtcctcccacaaagtcttattcaagaaataaataccatatttcattg

SEQ ID NO: 457591 - DNA, 1008 bp, Homo sapiens
gggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggtaggactctacagcatttgactttttacattgttttaaagtccttccttcaagtgtaaaatgtattgatatgggtaatatattcatgtgattcaagaatccaaaggtaaaaaagagaatataattaaaaatctgtctcccatccttgtcacccagacacctgcctcctctcatgggaggtagtcattggaaccactgactcatgtgtcctcccacaaagtcttattcaagaaataaataccatatttcattg

SEQ ID NO: 457592 - DNA, 401 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcagaaccgcggcaggggccaagcctcctcaactatgacctcaaccggccaggattccaccacaaccaggcagcgaagaagtaggcagggttcgcccagctaacccacctgctcatgggtctggcaggaggcaagctgatcctgtctctggaggtgagtgactcaccttcgtccctcagcct

SEQ ID NO: 457593 - DNA, 358 bp, Homo sapiens
caatggccacatgctccaacaccatggaaattctggacacccgctggtcctcagctacatcgacctgtcagcctggtgttactactgtcaggcctatgtccaccaccaggtgggccctgggtagacccttcgacacgtgcacactcaccccccacacacacaccccttctgtgattgggtaaagggagaccacaggcccctctgcatggctgcctcatgtgattattttgcatggggcgggggctgtgggatagtccagaagacagagtggttgagggctggagtgggggcagccctgcagccgaggtagaggggtcctcactctctctcacctgccctattcttgcctcctcctcag

SEQ ID NO: 457594 - DNA, 358 bp, Homo sapiens
tgcatctatttcttctacctctgagtctgtatttcttttcttcccttcttcattttcagtctctgcttttgtgtctcctagtctccaggttctgtgtctccatctctctgacttgcatctccatgtcttcatttgtccttttctccatgtctctgggtcgccatcacttactgcctaccaaaagcccctaccctcatgcttatacatctcttctctccctgcctcagtttaacccagaactggtgctggtctcagctggctttgatgctgcacggggggatccgctggggggctgccaggtgtcacctgagggttatgcccacctcacccacctgctgatgggccttgccagtggccg

SEQ ID NO: 457595 - DNA, 4135 bp, Homo sapiens
gggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457596 - DNA, 743 bp, Homo sapiens
gggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggag

SEQ ID NO: 457597 - DNA, 4228 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457598 - DNA, 4544 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcaggttcgtgaaggaatggggtctgggctgggcttagagggtctgggaatggggcttaggagagtagaaggggcggtgattggttggaaagggcaggccctaagacggactgtgtgagcccgggggctcattgctccgtgaaagggcaagaccagggaaagagaatcgtgtaaaaggggtggagtctagcgggccgggcggggccgggtagaatggccacctgagtggagggagaaggcctgagagaggcggagtttggaaggctgtggagaatcagatcgcaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457599 - DNA, 4961 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggagagtttgatgtgtgtcaggtgcttagaacagggcctgatatataatcagcccatgatgagctattactgttatcatgatctgattgtgtgaatagatggtggatgtgtggacagagtgatcggggttcccccaggggcttccagatttagaggcctagtgctatgtggcttgaggaaagctagcttccagagcaggtatctgagctgaactttaagaggagaaaaagagtgagtcagatgaagagggtgactgagggaagggaagaacagacagctgaaccagtgtggccaaaggcctgaaagtaggatttggtgtggctactgcaggggagcagagaacattacctgaactgaggcgggctagggaagaaacagaatgtgtcttatatcctggctattccttcaggttgacagttgggggagccaagccctaatttgaccagggggttggtgtatggacagctcagttggggaagagacagggccctgaatctcatctcccatctgtgtctagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457600 - DNA, 3885 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457601 - DNA, 4161 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 457602 - DNA, 3755 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcagtctactgtgtcggtaactaatggcaaatgctcacacatggaattttgaacccgctgctctagtactgacttagctgtttatatgtaggc

SEQ ID NO: 457603 - DNA, 2327 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggtgtgtcctctgtgggctggggagaggaggacctggggggaatggaaaaagagagccatctgctgtttctggaggctctgagagagtcaagcagggcctgaggaaaggggccatggggaggggcacgggagggggtgggcctagaggctgggggaataatggaaggaactggagaaagggaagggtggccaagtgcagtggctcacgtctgtaatcctagcgctttgagaagctgaggtgagctcaggaggtcaaggctgcagtaagccatgattgcaccactgcactctagcctgggcaacagagtgagaccctgtgtc

SEQ ID NO: 457604 - DNA, 1072 bp, Homo sapiens
gggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcaggttcgtgaaggaatggggtctgggctgggcttagagggtctgggaatggggcttaggagagtagaaggggcggtgattggttggaaagggcaggccctaagacggactgtgtgagcccgggggctcattgctccgtgaaagggcaagaccagggaaagagaatcgtgtaaaaggggtggagtctagcgggccgggcggggccgggtagaatggccacctgagtggagggagaaggcctgagagaggcggagtttggaaggctgtggagaatcagatcgcaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacaggtgaggctgggtcctccaggctgtctccaaaccacaaaaatacacacacttagagcccattagcaagaataaatcttttcttaccccagcctggatactggaagcagatgatttggggaggtagggctcacacttgaaagggttcttttatgtagctaacaaacatttattgagtgcctattgtgtgccaagagttggtgatacaaatgtaccaaacaacagacagggg

SEQ ID NO: 457605 - DNA, 4330 bp, Homo sapiens
gaattccgcgccagggccgaccgttcttcctgtactacgcttcccaccacactcactaccctcagttcagtggacaaagcttcaccaagcgctcaggccgtgggccatttggggactccttgatggagctggatggagctgtaggggccttgatgacaactgtgggggacctcggtctgctggaagagacactagtcatcttcactgcagataacggtcctgagttgatgcgcatgtccaatggcggctgctctggcctcttgagatgtggaaaaggaacaacttttgaaggtggcgtccgagagcctgccttggtctactggccaggtcacattactcctggtgtaacccatgagctggccagctctctggacctgctgcccaccctggcagccctgaccggggtccgctgcccaacgtcaccttggatggtgttgacatcagccccttgctgctaggcacaggcaagagcccacggaagtctgtcttcttctacccgccctacccagacgagatccatggggtctttgctgttcggaatgggaaatacaaggctcatttcttcacccagggctccgcccacagtgacaccacttcagatcctgcctgtcatgctgccaaccgtctgacggctcatgagcccccactgctctacgacttatctcaggaccctggggagaactacaatgttttggaaaaccacagagggaagagatgggaaaatggctgtccaggagttttcggaattcggggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457606 - DNA, 3849 bp, Homo sapiens
tccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457607 - DNA, 3633 bp, Homo sapiens
ggccgaggatggcaacactccagattcagcctcagacagaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457608 - DNA, 3563 bp, Homo sapiens
gaattccgcgccagggccgaccgttcttcctgtactacgcttcccaccacactcactaccctcagttcagtggacaaagcttcaccaagcgctcaggccgtgggccatttggggactccttgatggagctggatggagctgtaggggccttgatgacaactgtgggggacctcggtctgctggaagagacactagtcatcttcactgcagataacggtcctgagttgatgcgcatgtccaatggcggctgctctggcctcttgagatgtggaaaaggaacaacttttgaaggtggcgtccgagagcctgccttggtctactggccaggtcacattactcctggtgtaacccatgagctggccagctctctggacctgctgcccaccctggcagccctgaccggggtccgctgcccaacgtcaccttggatggtgttgacatcagccccttgctgctaggcacaggcaagagcccacggaagtctgtcttcttctacccgccctacccagacgagatccatggggtctttgctgttcggaatgggaaatacaaggctcatttcttcacccagggctccgcccacagtgacaccacttcagatcctgcctgtcatgctgccaaccgtctgacggctcatgagcccccactgctctacgacttatctcaggaccctggggagaactacaatgttttggaaaaccacagagggaagagatgggaaaatggctgtccaggagttttcggaattcggggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgta

SEQ ID NO: 457609 - DNA, 3169 bp, Homo sapiens
gaattccgcgccagggccgaccgttcttcctgtactacgcttcccaccacactcactaccctcagttcagtggacaaagcttcaccaagcgctcaggccgtgggccatttggggactccttgatggagctggatggagctgtaggggccttgatgacaactgtgggggacctcggtctgctggaagagacactagtcatcttcactgcagataacggtcctgagttgatgcgcatgtccaatggcggctgctctggcctcttgagatgtggaaaaggaacaacttttgaaggtggcgtccgagagcctgccttggtctactggccaggtcacattactcctggtgtaacccatgagctggccagctctctggacctgctgcccaccctggcagccctgaccggggtccgctgcccaacgtcaccttggatggtgttgacatcagccccttgctgctaggcacaggcaagagcccacggaagtctgtcttcttctacccgccctacccagacgagatccatggggtctttgctgttcggaatgggaaatacaaggctcatttcttcacccagggctccgcccacagtgacaccacttcagatcctgcctgtcatgctgccaaccgtctgacggctcatgagcccccactgctctacgacttatctcaggaccctggggagaactacaatgttttggaaaaccacagagggaagagatgggaaaatggctgtccaggagttttcggaattcggggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactga

SEQ ID NO: 457610 - DNA, 1776 bp, Homo sapiens
  misc_feature (1741)..(1741): n is a, c, g, or t
  misc_feature (1750)..(1750): n is a, c, g, or t
  misc_feature (1769)..(1769): n is a, c, g, or t
tccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagagggttgggcacttttttnaccaatctnccaatttttaaggaaaatnttttggg

SEQ ID NO: 457611 - DNA, 1290 bp, Homo sapiens
tataaaccagctacttgatgtaactggtttatatttagattatctcaagtaggggggaataaccatgtgtaggaattcatagaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457612 - DNA, 262 bp, Homo sapiens
ctagctcccaatgtgcaatggaactgtatacactttgcatgaaattgaattgaatgaaatcttaagccagactgagagttaggtagtccttaaaaattttaatgtttcttcttttccttttccaggttccattgccttctctttcccccacaatgcaggcaggcaccatagcccgttgggaaaaaaaagagggggacaaaatcaatgaaggtgacctaattgcagaggtaagttttttttttttttttttaattaatttatt

SEQ ID NO: 457613 - DNA, 4347 bp, Homo sapiens
gaattccgcgccagggccgaccgttcttcctgtactacgcttcccaccacactcactaccctcagttcagtggacaaagcttcaccaagcgctcaggccgtgggccatttggggactccttgatggagctggatggagctgtaggggccttgatgacaactgtgggggacctcggtctgctggaagagacactagtcatcttcactgcagataacggtcctgagttgatgcgcatgtccaatggcggctgctctggcctcttgagatgtggaaaaggaacaacttttgaaggtggcgtccgagagcctgccttggtctactggccaggtcacattactcctggtgtaacccatgagctggccagctctctggacctgctgcccaccctggcagccctgaccggggtccgctgcccaacgtcaccttggatggtgttgacatcagccccttgctgctaggcacaggcaagagcccacggaagtctgtcttcttctacccgccctacccagacgagatccatggggtctttgctgttcggaatgggaaatacaaggctcatttcttcacccagggctccgcccacagtgacaccacttcagatcctgcctgtcatgctgccaaccgtctgacggctcatgagcccccactgctctacgacttatctcaggaccctggggagaactacaatgttttggaaaaccacagagggaagagatgggaaaatggctgtccaggagttttcggaattcggggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457614 - DNA, 3988 bp, Homo sapiens
  misc_feature (1)..(1): n is a, c, g, or t
  misc_feature (14)..(14): n is a, c, g, or t
  misc_feature (21)..(21): n is a, c, g, or t
  misc_feature (74)..(74): n is a, c, g, or t
  misc_feature (79)..(79): n is a, c, g, or t
naaaactgccatanggctcgncgtgggggtccttccaggtgatggcaagaggaacccaggcaacaacagggaanttaanaggaaagcatatgtggaggcatggaaggatggaaagaaacagccctggagatccctgggaaactgcctaccagttcagagaggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457615 - DNA, 4184 bp, Homo sapiens
  misc_feature (3322)..(3322): n is a, c, g, or t
gaattccgcgccagggccgaccgttcttcctgtactacgcttcccaccacactcactaccctcagttcagtggacaaagcttcaccaagcgctcaggccgtgggccatttggggactccttgatggagctggatggagctgtaggggccttgatgacaactgtgggggacctcggtctgctggaagagacactagtcatcttcactgcagataacggtcctgagttgatgcgcatgtccaatggcggctgctctggcctcttgagatgtggaaaaggaacaacttttgaaggtggcgtccgagagcctgccttggtctactggccaggtcacattactcctggtgtaacccatgagctggccagctctctggacctgctgcccaccctggcagccctgaccggggtccgctgcccaacgtcaccttggatggtgttgacatcagccccttgctgctaggcacaggcaagagcccacggaagtctgtcttcttctacccgccctacccagacgagatccatggggtctttgctgttcggaatgggaaatacaaggctcatttcttcacccagggctccgcccacagtgacaccacttcagatcctgcctgtcatgctgccaaccgtctgacggctcatgagcccccactgctctacgacttatctcaggaccctggggagaactacaatgttttggaaaaccacagagggaagagatgggaaaatggctgtccaggagttttcggaattcggggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttccacagtggagtcataaattctgttcattatgtncatttacaatgaactaccagttaatcttagaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457616 - DNA, 3534 bp, Homo sapiens
tccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcaggaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaatatgt

SEQ ID NO: 457617 - DNA, 350 bp, Homo sapiens
gccccgtctcaccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatgtggcgcgtctgtgcgcgacgggctcaga

SEQ ID NO: 457618 - DNA, 1017 bp, Homo sapiens
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaagtatgtattaaagctgaccttttttttcctatgctgcaagtagttaaatgccacatttaagtcattattctgtctggcaaaaataatatagaaactttatatgcctagatttcccttaattcctaattaaatgttcttaacacagaaaatcagagagctttaattacaatgt

SEQ ID NO: 457619 - DNA, 3967 bp, Homo sapiens
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttgaaggaagcaaagttcaaaatgcttttaaaattggggatgctttggcaagcccccccaatttggggctctcttgacaatttacccttatggggattccaatggcaattaatgtgaaaacccttttaaaaccccaatttttggaaaaacctggggggtcccccaaataaatgggtttggaaaaaacccggtgttccccaactgtcgtcctttccaaaaagttcccacttttgagcctttaccgaaaaattgtaaagcccaaattgcaatgggaatttgggtttatttttggttaaatttggtccatggggc

SEQ ID NO: 457620 - DNA, 4082 bp, Homo sapiens
  misc_feature (3624)..(3624): n is a, c, g, or t
  misc_feature (3641)..(3642): n is a, c, g, or t
  misc_feature (3682)..(3682): n is a, c, g, or t
  misc_feature (3688)..(3689): n is a, c, g, or t
  misc_feature (3696)..(3697): n is a, c, g, or t
  misc_feature (3708)..(3708): n is a, c, g, or t
  misc_feature (3710)..(3710): n is a, c, g, or t
  misc_feature (3725)..(3725): n is a, c, g, or t
  misc_feature (3730)..(3731): n is a, c, g, or t
  misc_feature (3737)..(3738): n is a, c, g, or t
  misc_feature (3743)..(3743): n is a, c, g, or t
  misc_feature (3747)..(3747): n is a, c, g, or t
  misc_feature (3749)..(3754): n is a, c, g, or t
  misc_feature (3756)..(3756): n is a, c, g, or t
  misc_feature (3759)..(3759): n is a, c, g, or t
  misc_feature (3772)..(3772): n is a, c, g, or t
  misc_feature (3785)..(3786): n is a, c, g, or t
  misc_feature (3789)..(3789): n is a, c, g, or t
  misc_feature (3792)..(3792): n is a, c, g, or t
  misc_feature (3794)..(3794): n is a, c, g, or t
  misc_feature (3796)..(3796): n is a, c, g, or t
  misc_feature (3800)..(3800): n is a, c, g, or t
  misc_feature (3808)..(3808): n is a, c, g, or t
  misc_feature (3810)..(3811): n is a, c, g, or t
  misc_feature (3825)..(3825): n is a, c, g, or t
  misc_feature (3835)..(3835): n is a, c, g, or t
  misc_feature (3839)..(3839): n is a, c, g, or t
  misc_feature (3842)..(3842): n is a, c, g, or t
  misc_feature (3849)..(3849): n is a, c, g, or t
  misc_feature (3855)..(3856): n is a, c, g, or t
  misc_feature (3862)..(3862): n is a, c, g, or t
  misc_feature (3865)..(3865): n is a, c, g, or t
  misc_feature (3869)..(3870): n is a, c, g, or t
  misc_feature (3877)..(3877): n is a, c, g, or t
  misc_feature (3879)..(3879): n is a, c, g, or t
  misc_feature (3882)..(3882): n is a, c, g, or t
  misc_feature (3885)..(3885): n is a, c, g, or t
  misc_feature (3888)..(3888): n is a, c, g, or t
  misc_feature (3891)..(3891): n is a, c, g, or t
  misc_feature (3895)..(3895): n is a, c, g, or t
  misc_feature (3907)..(3908): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457621 - DNA, 4098 bp, Homo sapiens
  misc_feature (3640)..(3640): n is a, c, g, or t
  misc_feature (3657)..(3658): n is a, c, g, or t
  misc_feature (3698)..(3698): n is a, c, g, or t
  misc_feature (3704)..(3705): n is a, c, g, or t
  misc_feature (3712)..(3713): n is a, c, g, or t
  misc_feature (3724)..(3724): n is a, c, g, or t
  misc_feature (3726)..(3726): n is a, c, g, or t
  misc_feature (3741)..(3741): n is a, c, g, or t
  misc_feature (3746)..(3747): n is a, c, g, or t
  misc_feature (3753)..(3754): n is a, c, g, or t
  misc_feature (3759)..(3759): n is a, c, g, or t
  misc_feature (3763)..(3763): n is a, c, g, or t
  misc_feature (3765)..(3770): n is a, c, g, or t
  misc_feature (3772)..(3772): n is a, c, g, or t
  misc_feature (3775)..(3775): n is a, c, g, or t
  misc_feature (3788)..(3788): n is a, c, g, or t
  misc_feature (3801)..(3802): n is a, c, g, or t
  misc_feature (3805)..(3805): n is a, c, g, or t
  misc_feature (3808)..(3808): n is a, c, g, or t
  misc_feature (3810)..(3810): n is a, c, g, or t
  misc_feature (3812)..(3812): n is a, c, g, or t
  misc_feature (3816)..(3816): n is a, c, g, or t
  misc_feature (3824)..(3824): n is a, c, g, or t
  misc_feature (3826)..(3827): n is a, c, g, or t
  misc_feature (3841)..(3841): n is a, c, g, or t
  misc_feature (3851)..(3851): n is a, c, g, or t
  misc_feature (3855)..(3855): n is a, c, g, or t
  misc_feature (3858)..(3858): n is a, c, g, or t
  misc_feature (3865)..(3865): n is a, c, g, or t
  misc_feature (3871)..(3872): n is a, c, g, or t
  misc_feature (3878)..(3878): n is a, c, g, or t
  misc_feature (3881)..(3881): n is a, c, g, or t
  misc_feature (3885)..(3886): n is a, c, g, or t
  misc_feature (3893)..(3893): n is a, c, g, or t
  misc_feature (3895)..(3895): n is a, c, g, or t
  misc_feature (3898)..(3898): n is a, c, g, or t
  misc_feature (3901)..(3901): n is a, c, g, or t
  misc_feature (3904)..(3904): n is a, c, g, or t
  misc_feature (3907)..(3907): n is a, c, g, or t
  misc_feature (3911)..(3911): n is a, c, g, or t
  misc_feature (3923)..(3924): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457622 - DNA, 4085 bp, Homo sapiens
  misc_feature (3627)..(3627): n is a, c, g, or t
  misc_feature (3644)..(3645): n is a, c, g, or t
  misc_feature (3685)..(3685): n is a, c, g, or t
  misc_feature (3691)..(3692): n is a, c, g, or t
  misc_feature (3699)..(3700): n is a, c, g, or t
  misc_feature (3711)..(3711): n is a, c, g, or t
  misc_feature (3713)..(3713): n is a, c, g, or t
  misc_feature (3728)..(3728): n is a, c, g, or t
  misc_feature (3733)..(3734): n is a, c, g, or t
  misc_feature (3740)..(3741): n is a, c, g, or t
  misc_feature (3746)..(3746): n is a, c, g, or t
  misc_feature (3750)..(3750): n is a, c, g, or t
  misc_feature (3752)..(3757): n is a, c, g, or t
  misc_feature (3759)..(3759): n is a, c, g, or t
  misc_feature (3762)..(3762): n is a, c, g, or t
  misc_feature (3775)..(3775): n is a, c, g, or t
  misc_feature (3788)..(3789): n is a, c, g, or t
  misc_feature (3792)..(3792): n is a, c, g, or t
  misc_feature (3795)..(3795): n is a, c, g, or t
  misc_feature (3797)..(3797): n is a, c, g, or t
  misc_feature (3799)..(3799): n is a, c, g, or t
  misc_feature (3803)..(3803): n is a, c, g, or t
  misc_feature (3811)..(3811): n is a, c, g, or t
  misc_feature (3813)..(3814): n is a, c, g, or t
  misc_feature (3828)..(3828): n is a, c, g, or t
  misc_feature (3838)..(3838): n is a, c, g, or t
  misc_feature (3842)..(3842): n is a, c, g, or t
  misc_feature (3845)..(3845): n is a, c, g, or t
  misc_feature (3852)..(3852): n is a, c, g, or t
  misc_feature (3858)..(3859): n is a, c, g, or t
  misc_feature (3865)..(3865): n is a, c, g, or t
  misc_feature (3868)..(3868): n is a, c, g, or t
  misc_feature (3872)..(3873): n is a, c, g, or t
  misc_feature (3880)..(3880): n is a, c, g, or t
  misc_feature (3882)..(3882): n is a, c, g, or t
  misc_feature (3885)..(3885): n is a, c, g, or t
  misc_feature (3888)..(3888): n is a, c, g, or t
  misc_feature (3891)..(3891): n is a, c, g, or t
  misc_feature (3894)..(3894): n is a, c, g, or t
  misc_feature (3898)..(3898): n is a, c, g, or t
  misc_feature (3910)..(3911): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaaccccatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457623 - DNA, 4085 bp, Homo sapiens
  misc_feature (3627)..(3627): n is a, c, g, or t
  misc_feature (3644)..(3645): n is a, c, g, or t
  misc_feature (3685)..(3685): n is a, c, g, or t
  misc_feature (3691)..(3692): n is a, c, g, or t
  misc_feature (3699)..(3700): n is a, c, g, or t
  misc_feature (3711)..(3711): n is a, c, g, or t
  misc_feature (3713)..(3713): n is a, c, g, or t
  misc_feature (3728)..(3728): n is a, c, g, or t
  misc_feature (3733)..(3734): n is a, c, g, or t
  misc_feature (3740)..(3741): n is a, c, g, or t
  misc_feature (3746)..(3746): n is a, c, g, or t
  misc_feature (3750)..(3750): n is a, c, g, or t
  misc_feature (3752)..(3757): n is a, c, g, or t
  misc_feature (3759)..(3759): n is a, c, g, or t
  misc_feature (3762)..(3762): n is a, c, g, or t
  misc_feature (3775)..(3775): n is a, c, g, or t
  misc_feature (3788)..(3789): n is a, c, g, or t
  misc_feature (3792)..(3792): n is a, c, g, or t
  misc_feature (3795)..(3795): n is a, c, g, or t
  misc_feature (3797)..(3797): n is a, c, g, or t
  misc_feature (3799)..(3799): n is a, c, g, or t
  misc_feature (3803)..(3803): n is a, c, g, or t
  misc_feature (3811)..(3811): n is a, c, g, or t
  misc_feature (3813)..(3814): n is a, c, g, or t
  misc_feature (3828)..(3828): n is a, c, g, or t
  misc_feature (3838)..(3838): n is a, c, g, or t
  misc_feature (3842)..(3842): n is a, c, g, or t
  misc_feature (3845)..(3845): n is a, c, g, or t
  misc_feature (3852)..(3852): n is a, c, g, or t
  misc_feature (3858)..(3859): n is a, c, g, or t
  misc_feature (3865)..(3865): n is a, c, g, or t
  misc_feature (3868)..(3868): n is a, c, g, or t
  misc_feature (3872)..(3873): n is a, c, g, or t
  misc_feature (3880)..(3880): n is a, c, g, or t
  misc_feature (3882)..(3882): n is a, c, g, or t
  misc_feature (3885)..(3885): n is a, c, g, or t
  misc_feature (3888)..(3888): n is a, c, g, or t
  misc_feature (3891)..(3891): n is a, c, g, or t
  misc_feature (3894)..(3894): n is a, c, g, or t
  misc_feature (3898)..(3898): n is a, c, g, or t
  misc_feature (3910)..(3911): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgagtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457624 - DNA, 1893 bp, Homo sapiens
  misc_feature (1435)..(1435): n is a, c, g, or t
  misc_feature (1452)..(1453): n is a, c, g, or t
  misc_feature (1493)..(1493): n is a, c, g, or t
  misc_feature (1499)..(1500): n is a, c, g, or t
  misc_feature (1507)..(1508): n is a, c, g, or t
  misc_feature (1519)..(1519): n is a, c, g, or t
  misc_feature (1521)..(1521): n is a, c, g, or t
  misc_feature (1536)..(1536): n is a, c, g, or t
  misc_feature (1541)..(1542): n is a, c, g, or t
  misc_feature (1548)..(1549): n is a, c, g, or t
  misc_feature (1554)..(1554): n is a, c, g, or t
  misc_feature (1558)..(1558): n is a, c, g, or t
  misc_feature (1560)..(1565): n is a, c, g, or t
  misc_feature (1567)..(1567): n is a, c, g, or t
  misc_feature (1570)..(1570): n is a, c, g, or t
  misc_feature (1583)..(1583): n is a, c, g, or t
  misc_feature (1596)..(1597): n is a, c, g, or t
  misc_feature (1600)..(1600): n is a, c, g, or t
  misc_feature (1603)..(1603): n is a, c, g, or t
  misc_feature (1605)..(1605): n is a, c, g, or t
  misc_feature (1607)..(1607): n is a, c, g, or t
  misc_feature (1611)..(1611): n is a, c, g, or t
  misc_feature (1619)..(1619): n is a, c, g, or t
  misc_feature (1621)..(1622): n is a, c, g, or t
  misc_feature (1636)..(1636): n is a, c, g, or t
  misc_feature (1646)..(1646): n is a, c, g, or t
  misc_feature (1650)..(1650): n is a, c, g, or t
  misc_feature (1653)..(1653): n is a, c, g, or t
  misc_feature (1660)..(1660): n is a, c, g, or t
  misc_feature (1666)..(1667): n is a, c, g, or t
  misc_feature (1673)..(1673): n is a, c, g, or t
  misc_feature (1676)..(1676): n is a, c, g, or t
  misc_feature (1680)..(1681): n is a, c, g, or t
  misc_feature (1688)..(1688): n is a, c, g, or t
  misc_feature (1690)..(1690): n is a, c, g, or t
  misc_feature (1693)..(1693): n is a, c, g, or t
  misc_feature (1696)..(1696): n is a, c, g, or t
  misc_feature (1699)..(1699): n is a, c, g, or t
  misc_feature (1702)..(1702): n is a, c, g, or t
  misc_feature (1706)..(1706): n is a, c, g, or t
  misc_feature (1718)..(1719): n is a, c, g, or t
cccccgggctgcaggaattcggcacgagctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457625 - DNA, 1735 bp, Homo sapiens
  misc_feature (1277)..(1277): n is a, c, g, or t
  misc_feature (1294)..(1295): n is a, c, g, or t
  misc_feature (1335)..(1335): n is a, c, g, or t
  misc_feature (1341)..(1342): n is a, c, g, or t
  misc_feature (1349)..(1350): n is a, c, g, or t
  misc_feature (1361)..(1361): n is a, c, g, or t
  misc_feature (1363)..(1363): n is a, c, g, or t
  misc_feature (1378)..(1378): n is a, c, g, or t
  misc_feature (1383)..(1384): n is a, c, g, or t
  misc_feature (1390)..(1391): n is a, c, g, or t
  misc_feature (1396)..(1396): n is a, c, g, or t
  misc_feature (1400)..(1400): n is a, c, g, or t
  misc_feature (1402)..(1407): n is a, c, g, or t
  misc_feature (1409)..(1409): n is a, c, g, or t
  misc_feature (1412)..(1412): n is a, c, g, or t
  misc_feature (1425)..(1425): n is a, c, g, or t
  misc_feature (1438)..(1439): n is a, c, g, or t
  misc_feature (1442)..(1442): n is a, c, g, or t
  misc_feature (1445)..(1445): n is a, c, g, or t
  misc_feature (1447)..(1447): n is a, c, g, or t
  misc_feature (1449)..(1449): n is a, c, g, or t
  misc_feature (1453)..(1453): n is a, c, g, or t
  misc_feature (1461)..(1461): n is a, c, g, or t
  misc_feature (1463)..(1464): n is a, c, g, or t
  misc_feature (1478)..(1478): n is a, c, g, or t
  misc_feature (1488)..(1488): n is a, c, g, or t
  misc_feature (1492)..(1492): n is a, c, g, or t
  misc_feature (1495)..(1495): n is a, c, g, or t
  misc_feature (1502)..(1502): n is a, c, g, or t
  misc_feature (1508)..(1509): n is a, c, g, or t
  misc_feature (1515)..(1515): n is a, c, g, or t
  misc_feature (1518)..(1518): n is a, c, g, or t
  misc_feature (1522)..(1523): n is a, c, g, or t
  misc_feature (1530)..(1530): n is a, c, g, or t
  misc_feature (1532)..(1532): n is a, c, g, or t
  misc_feature (1535)..(1535): n is a, c, g, or t
  misc_feature (1538)..(1538): n is a, c, g, or t
  misc_feature (1541)..(1541): n is a, c, g, or t
  misc_feature (1544)..(1544): n is a, c, g, or t
  misc_feature (1548)..(1548): n is a, c, g, or t
  misc_feature (1560)..(1561): n is a, c, g, or t
ctcggtacccacctcctaccccaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457626 - DNA, 3586 bp, Homo sapiens
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccatttaaattctgaatatcatgaaggatattcattcagtaacagagtggcgatatatagcgaaattgttttccaaaaaaagttaaccctcttctttatatatgccacgttggttcttcccgtcatttaaaaatggtccttaaaaaaaaaagaaaaagaagaaagaggagcagcaacaagagagaaaagaaagccaagttggcgggagataaatataaggcaccaagttgacg

SEQ ID NO: 457627 - DNA, 1532 bp, Homo sapiens
  misc_feature (103)..(103): n is a, c, g, or t
  misc_feature (1074)..(1074): n is a, c, g, or t
  misc_feature (1091)..(1092): n is a, c, g, or t
  misc_feature (1132)..(1132): n is a, c, g, or t
  misc_feature (1138)..(1139): n is a, c, g, or t
  misc_feature (1146)..(1147): n is a, c, g, or t
  misc_feature (1158)..(1158): n is a, c, g, or t
  misc_feature (1160)..(1160): n is a, c, g, or t
  misc_feature (1175)..(1175): n is a, c, g, or t
  misc_feature (1180)..(1181): n is a, c, g, or t
  misc_feature (1187)..(1188): n is a, c, g, or t
  misc_feature (1193)..(1193): n is a, c, g, or t
  misc_feature (1197)..(1197): n is a, c, g, or t
  misc_feature (1199)..(1204): n is a, c, g, or t
  misc_feature (1206)..(1206): n is a, c, g, or t
  misc_feature (1209)..(1209): n is a, c, g, or t
  misc_feature (1222)..(1222): n is a, c, g, or t
  misc_feature (1235)..(1236): n is a, c, g, or t
  misc_feature (1239)..(1239): n is a, c, g, or t
  misc_feature (1242)..(1242): n is a, c, g, or t
  misc_feature (1244)..(1244): n is a, c, g, or t
  misc_feature (1246)..(1246): n is a, c, g, or t
  misc_feature (1250)..(1250): n is a, c, g, or t
  misc_feature (1258)..(1258): n is a, c, g, or t
  misc_feature (1260)..(1261): n is a, c, g, or t
  misc_feature (1275)..(1275): n is a, c, g, or t
  misc_feature (1285)..(1285): n is a, c, g, or t
  misc_feature (1289)..(1289): n is a, c, g, or t
  misc_feature (1292)..(1292): n is a, c, g, or t
  misc_feature (1299)..(1299): n is a, c, g, or t
  misc_feature (1305)..(1306): n is a, c, g, or t
  misc_feature (1312)..(1312): n is a, c, g, or t
  misc_feature (1315)..(1315): n is a, c, g, or t
  misc_feature (1319)..(1320): n is a, c, g, or t
  misc_feature (1327)..(1327): n is a, c, g, or t
  misc_feature (1329)..(1329): n is a, c, g, or t
  misc_feature (1332)..(1332): n is a, c, g, or t
  misc_feature (1335)..(1335): n is a, c, g, or t
  misc_feature (1338)..(1338): n is a, c, g, or t
  misc_feature (1341)..(1341): n is a, c, g, or t
  misc_feature (1345)..(1345): n is a, c, g, or t
  misc_feature (1357)..(1358): n is a, c, g, or t
tcctggtgtgttgttttagcttgcctggtctggctgtgcgggatgttgtgtgtgtttatgtttgttagatcggtgtgtctgtttgtgtctctggctttgcttnctatttttagtcgcgtgagtatttctaataaccggagcacaatttctcgcgcgcaatcgctggcgtgaccgagtcaccggcgacgtttatattcccggactttatattctttggaggaggggtccgaatatgtgaccacgccaacgaagagggctctttcccagaagtccccaggagcaggtgttcccgcacagagctgtggtgtacgcccgcccgtgcttcgcgtttttaggtctctccctatttgggggccccctttaaaaaaaaaggggggcaatggggcccccccgggggatttttttttccccccccccctttttttttttttttttttttttttttgttttttttgtttttttttcaccaatgaacatttattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457628 - DNA, 1011 bp, Homo sapiens
  misc_feature (611)..(611): n is a, c, g, or t
  misc_feature (617)..(618): n is a, c, g, or t
  misc_feature (625)..(626): n is a, c, g, or t
  misc_feature (637)..(637): n is a, c, g, or t
  misc_feature (639)..(639): n is a, c, g, or t
  misc_feature (654)..(654): n is a, c, g, or t
  misc_feature (659)..(660): n is a, c, g, or t
  misc_feature (666)..(667): n is a, c, g, or t
  misc_feature (672)..(672): n is a, c, g, or t
  misc_feature (676)..(676): n is a, c, g, or t
  misc_feature (678)..(683): n is a, c, g, or t
  misc_feature (685)..(685): n is a, c, g, or t
  misc_feature (688)..(688): n is a, c, g, or t
  misc_feature (701)..(701): n is a, c, g, or t
  misc_feature (714)..(715): n is a, c, g, or t
  misc_feature (718)..(718): n is a, c, g, or t
  misc_feature (721)..(721): n is a, c, g, or t
  misc_feature (723)..(723): n is a, c, g, or t
  misc_feature (725)..(725): n is a, c, g, or t
  misc_feature (729)..(729): n is a, c, g, or t
  misc_feature (737)..(737): n is a, c, g, or t
  misc_feature (739)..(740): n is a, c, g, or t
  misc_feature (754)..(754): n is a, c, g, or t
  misc_feature (764)..(764): n is a, c, g, or t
  misc_feature (768)..(768): n is a, c, g, or t
  misc_feature (771)..(771): n is a, c, g, or t
  misc_feature (778)..(778): n is a, c, g, or t
  misc_feature (784)..(785): n is a, c, g, or t
  misc_feature (791)..(791): n is a, c, g, or t
  misc_feature (794)..(794): n is a, c, g, or t
  misc_feature (798)..(799): n is a, c, g, or t
  misc_feature (806)..(806): n is a, c, g, or t
  misc_feature (808)..(808): n is a, c, g, or t
  misc_feature (811)..(811): n is a, c, g, or t
  misc_feature (814)..(814): n is a, c, g, or t
  misc_feature (817)..(817): n is a, c, g, or t
  misc_feature (820)..(820): n is a, c, g, or t
  misc_feature (824)..(824): n is a, c, g, or t
  misc_feature (836)..(837): n is a, c, g, or t
aagcatgctcaactgttgttaagaacgatcattgctgccctcctctttattatgacagcagctgaaaaaaggatgatctgcaacaagattaagatgtgtaataacaggatttttccagtagtcacgttgttgtacaacggccagtaaattattgttagtaggcaccataatagaacaattatgtcgcatgaaggagtaggtaatcatgtatcatctacaacagcggcctcctactactactactgctcgaattcaagcttctaacgatgtacggggaaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacattttggcccccttggcccatgttacttttaaactgggcaatttttttttttcggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457629 - DNA, 4139 bp, Homo sapiens
  misc_feature (3681)..(3681): n is a, c, g, or t
  misc_feature (3698)..(3699): n is a, c, g, or t
  misc_feature (3739)..(3739): n is a, c, g, or t
  misc_feature (3745)..(3746): n is a, c, g, or t
  misc_feature (3753)..(3754): n is a, c, g, or t
  misc_feature (3765)..(3765): n is a, c, g, or t
  misc_feature (3767)..(3767): n is a, c, g, or t
  misc_feature (3782)..(3782): n is a, c, g, or t
  misc_feature (3787)..(3788): n is a, c, g, or t
  misc_feature (3794)..(3795): n is a, c, g, or t
  misc_feature (3800)..(3800): n is a, c, g, or t
  misc_feature (3804)..(3804): n is a, c, g, or t
  misc_feature (3806)..(3811): n is a, c, g, or t
  misc_feature (3813)..(3813): n is a, c, g, or t
  misc_feature (3816)..(3816): n is a, c, g, or t
  misc_feature (3829)..(3829): n is a, c, g, or t
  misc_feature (3842)..(3843): n is a, c, g, or t
  misc_feature (3846)..(3846): n is a, c, g, or t
  misc_feature (3849)..(3849): n is a, c, g, or t
  misc_feature (3851)..(3851): n is a, c, g, or t
  misc_feature (3853)..(3853): n is a, c, g, or t
  misc_feature (3857)..(3857): n is a, c, g, or t
  misc_feature (3865)..(3865): n is a, c, g, or t
  misc_feature (3867)..(3868): n is a, c, g, or t
  misc_feature (3882)..(3882): n is a, c, g, or t
  misc_feature (3892)..(3892): n is a, c, g, or t
  misc_feature (3896)..(3896): n is a, c, g, or t
  misc_feature (3899)..(3899): n is a, c, g, or t
  misc_feature (3906)..(3906): n is a, c, g, or t
  misc_feature (3912)..(3913): n is a, c, g, or t
  misc_feature (3919)..(3919): n is a, c, g, or t
  misc_feature (3922)..(3922): n is a, c, g, or t
  misc_feature (3926)..(3927): n is a, c, g, or t
  misc_feature (3934)..(3934): n is a, c, g, or t
  misc_feature (3936)..(3936): n is a, c, g, or t
  misc_feature (3939)..(3939): n is a, c, g, or t
  misc_feature (3942)..(3942): n is a, c, g, or t
  misc_feature (3945)..(3945): n is a, c, g, or t
  misc_feature (3948)..(3948): n is a, c, g, or t
  misc_feature (3952)..(3952): n is a, c, g, or t
  misc_feature (3964)..(3965): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457630 - DNA, 4118 bp, Homo sapiens
  misc_feature (3718)..(3718): n is a, c, g, or t
  misc_feature (3724)..(3725): n is a, c, g, or t
  misc_feature (3732)..(3733): n is a, c, g, or t
  misc_feature (3744)..(3744): n is a, c, g, or t
  misc_feature (3746)..(3746): n is a, c, g, or t
  misc_feature (3761)..(3761): n is a, c, g, or t
  misc_feature (3766)..(3767): n is a, c, g, or t
  misc_feature (3773)..(3774): n is a, c, g, or t
  misc_feature (3779)..(3779): n is a, c, g, or t
  misc_feature (3783)..(3783): n is a, c, g, or t
  misc_feature (3785)..(3790): n is a, c, g, or t
  misc_feature (3792)..(3792): n is a, c, g, or t
  misc_feature (3795)..(3795): n is a, c, g, or t
  misc_feature (3808)..(3808): n is a, c, g, or t
  misc_feature (3821)..(3822): n is a, c, g, or t
  misc_feature (3825)..(3825): n is a, c, g, or t
  misc_feature (3828)..(3828): n is a, c, g, or t
  misc_feature (3830)..(3830): n is a, c, g, or t
  misc_feature (3832)..(3832): n is a, c, g, or t
  misc_feature (3836)..(3836): n is a, c, g, or t
  misc_feature (3844)..(3844): n is a, c, g, or t
  misc_feature (3846)..(3847): n is a, c, g, or t
  misc_feature (3861)..(3861): n is a, c, g, or t
  misc_feature (3871)..(3871): n is a, c, g, or t
  misc_feature (3875)..(3875): n is a, c, g, or t
  misc_feature (3878)..(3878): n is a, c, g, or t
  misc_feature (3885)..(3885): n is a, c, g, or t
  misc_feature (3891)..(3892): n is a, c, g, or t
  misc_feature (3898)..(3898): n is a, c, g, or t
  misc_feature (3901)..(3901): n is a, c, g, or t
  misc_feature (3905)..(3906): n is a, c, g, or t
  misc_feature (3913)..(3913): n is a, c, g, or t
  misc_feature (3915)..(3915): n is a, c, g, or t
  misc_feature (3918)..(3918): n is a, c, g, or t
  misc_feature (3921)..(3921): n is a, c, g, or t
  misc_feature (3924)..(3924): n is a, c, g, or t
  misc_feature (3927)..(3927): n is a, c, g, or t
  misc_feature (3931)..(3931): n is a, c, g, or t
  misc_feature (3943)..(3944): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacattttggcccccttggcccatgttacttttaaactgggcaatttttttttttcggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457631 - DNA, 3835 bp, Homo sapiens
  misc_feature (3377)..(3377): n is a, c, g, or t
  misc_feature (3394)..(3395): n is a, c, g, or t
  misc_feature (3435)..(3435): n is a, c, g, or t
  misc_feature (3441)..(3442): n is a, c, g, or t
  misc_feature (3449)..(3450): n is a, c, g, or t
  misc_feature (3461)..(3461): n is a, c, g, or t
  misc_feature (3463)..(3463): n is a, c, g, or t
  misc_feature (3478)..(3478): n is a, c, g, or t
  misc_feature (3483)..(3484): n is a, c, g, or t
  misc_feature (3490)..(3491): n is a, c, g, or t
  misc_feature (3496)..(3496): n is a, c, g, or t
  misc_feature (3500)..(3500): n is a, c, g, or t
  misc_feature (3502)..(3507): n is a, c, g, or t
  misc_feature (3509)..(3509): n is a, c, g, or t
  misc_feature (3512)..(3512): n is a, c, g, or t
  misc_feature (3525)..(3525): n is a, c, g, or t
  misc_feature (3538)..(3539): n is a, c, g, or t
  misc_feature (3542)..(3542): n is a, c, g, or t
  misc_feature (3545)..(3545): n is a, c, g, or t
  misc_feature (3547)..(3547): n is a, c, g, or t
  misc_feature (3549)..(3549): n is a, c, g, or t
  misc_feature (3553)..(3553): n is a, c, g, or t
  misc_feature (3561)..(3561): n is a, c, g, or t
  misc_feature (3563)..(3564): n is a, c, g, or t
  misc_feature (3578)..(3578): n is a, c, g, or t
  misc_feature (3588)..(3588): n is a, c, g, or t
  misc_feature (3592)..(3592): n is a, c, g, or t
  misc_feature (3595)..(3595): n is a, c, g, or t
  misc_feature (3602)..(3602): n is a, c, g, or t
  misc_feature (3608)..(3609): n is a, c, g, or t
  misc_feature (3615)..(3615): n is a, c, g, or t
  misc_feature (3618)..(3618): n is a, c, g, or t
  misc_feature (3622)..(3623): n is a, c, g, or t
  misc_feature (3630)..(3630): n is a, c, g, or t
  misc_feature (3632)..(3632): n is a, c, g, or t
  misc_feature (3635)..(3635): n is a, c, g, or t
  misc_feature (3638)..(3638): n is a, c, g, or t
  misc_feature (3641)..(3641): n is a, c, g, or t
  misc_feature (3644)..(3644): n is a, c, g, or t
  misc_feature (3648)..(3648): n is a, c, g, or t
  misc_feature (3660)..(3661): n is a, c, g, or t
ttttttttcttcatatcttccccaaaatttctaactttatataaatttagacttggtttctgttgagtcttttactagtttgagacattttattgcagtatagtgcaaagtattaatgggctaagtatgttaaatgctgctgtatttgtaagatctcttgctttgtctgtgaccatgaaagtctcagtgaaatgggatcttattccctaaatcatagctctggttttaatgtttcttgatattattgcagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457632 - DNA, 3780 bp, Homo sapiens
  misc_feature (3322)..(3322): n is a, c, g, or t
  misc_feature (3339)..(3340): n is a, c, g, or t
  misc_feature (3380)..(3380): n is a, c, g, or t
  misc_feature (3386)..(3387): n is a, c, g, or t
  misc_feature (3394)..(3395): n is a, c, g, or t
  misc_feature (3406)..(3406): n is a, c, g, or t
  misc_feature (3408)..(3408): n is a, c, g, or t
  misc_feature (3423)..(3423): n is a, c, g, or t
  misc_feature (3428)..(3429): n is a, c, g, or t
  misc_feature (3435)..(3436): n is a, c, g, or t
  misc_feature (3441)..(3441): n is a, c, g, or t
  misc_feature (3445)..(3445): n is a, c, g, or t
  misc_feature (3447)..(3452): n is a, c, g, or t
  misc_feature (3454)..(3454): n is a, c, g, or t
  misc_feature (3457)..(3457): n is a, c, g, or t
  misc_feature (3470)..(3470): n is a, c, g, or t
  misc_feature (3483)..(3484): n is a, c, g, or t
  misc_feature (3487)..(3487): n is a, c, g, or t
  misc_feature (3490)..(3490): n is a, c, g, or t
  misc_feature (3492)..(3492): n is a, c, g, or t
  misc_feature (3494)..(3494): n is a, c, g, or t
  misc_feature (3498)..(3498): n is a, c, g, or t
  misc_feature (3506)..(3506): n is a, c, g, or t
  misc_feature (3508)..(3509): n is a, c, g, or t
  misc_feature (3523)..(3523): n is a, c, g, or t
  misc_feature (3533)..(3533): n is a, c, g, or t
  misc_feature (3537)..(3537): n is a, c, g, or t
  misc_feature (3540)..(3540): n is a, c, g, or t
  misc_feature (3547)..(3547): n is a, c, g, or t
  misc_feature (3553)..(3554): n is a, c, g, or t
  misc_feature (3560)..(3560): n is a, c, g, or t
  misc_feature (3563)..(3563): n is a, c, g, or t
  misc_feature (3567)..(3568): n is a, c, g, or t
  misc_feature (3575)..(3575): n is a, c, g, or t
  misc_feature (3577)..(3577): n is a, c, g, or t
  misc_feature (3580)..(3580): n is a, c, g, or t
  misc_feature (3583)..(3583): n is a, c, g, or t
  misc_feature (3586)..(3586): n is a, c, g, or t
  misc_feature (3589)..(3589): n is a, c, g, or t
  misc_feature (3593)..(3593): n is a, c, g, or t
  misc_feature (3605)..(3606): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457633 - DNA, 4085 bp, Homo sapiens
  misc_feature (3627)..(3627): n is a, c, g, or t
  misc_feature (3644)..(3645): n is a, c, g, or t
  misc_feature (3685)..(3685): n is a, c, g, or t
  misc_feature (3691)..(3692): n is a, c, g, or t
  misc_feature (3699)..(3700): n is a, c, g, or t
  misc_feature (3711)..(3711): n is a, c, g, or t
  misc_feature (3713)..(3713): n is a, c, g, or t
  misc_feature (3728)..(3728): n is a, c, g, or t
  misc_feature (3733)..(3734): n is a, c, g, or t
  misc_feature (3740)..(3741): n is a, c, g, or t
  misc_feature (3746)..(3746): n is a, c, g, or t
  misc_feature (3750)..(3750): n is a, c, g, or t
  misc_feature (3752)..(3757): n is a, c, g, or t
  misc_feature (3759)..(3759): n is a, c, g, or t
  misc_feature (3762)..(3762): n is a, c, g, or t
  misc_feature (3775)..(3775): n is a, c, g, or t
  misc_feature (3788)..(3789): n is a, c, g, or t
  misc_feature (3792)..(3792): n is a, c, g, or t
  misc_feature (3795)..(3795): n is a, c, g, or t
  misc_feature (3797)..(3797): n is a, c, g, or t
  misc_feature (3799)..(3799): n is a, c, g, or t
  misc_feature (3803)..(3803): n is a, c, g, or t
  misc_feature (3811)..(3811): n is a, c, g, or t
  misc_feature (3813)..(3814): n is a, c, g, or t
  misc_feature (3828)..(3828): n is a, c, g, or t
  misc_feature (3838)..(3838): n is a, c, g, or t
  misc_feature (3842)..(3842): n is a, c, g, or t
  misc_feature (3845)..(3845): n is a, c, g, or t
  misc_feature (3852)..(3852): n is a, c, g, or t
  misc_feature (3858)..(3859): n is a, c, g, or t
  misc_feature (3865)..(3865): n is a, c, g, or t
  misc_feature (3868)..(3868): n is a, c, g, or t
  misc_feature (3872)..(3873): n is a, c, g, or t
  misc_feature (3880)..(3880): n is a, c, g, or t
  misc_feature (3882)..(3882): n is a, c, g, or t
  misc_feature (3885)..(3885): n is a, c, g, or t
  misc_feature (3888)..(3888): n is a, c, g, or t
  misc_feature (3891)..(3891): n is a, c, g, or t
  misc_feature (3894)..(3894): n is a, c, g, or t
  misc_feature (3898)..(3898): n is a, c, g, or t
  misc_feature (3910)..(3911): n is a, c, g, or t
agcggagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgctgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttnggcccttttggcccaannatttttaaactcgaaaaatttttttaatggggcccaattnggggcnnatttggnnaattccccctntnggggggcgtttaaanataannggcccnnttttntaanannnnnngnttnggaaaaccctggnttcccaaattaanngcnttngnanaaancccctttncnnaattgggaaatacnaaaaggcccnaccngtngcctttncaaaanntggcanccntaannggcaatngnaanttnaangcntaantttttgaaaaannccggtaaaaattttttaaatcacgtctttttttaaccaaatggcccaaattgtaaattcctttttaattaaaaaaattcacccttaaggtgttagagtttctccattttgaacaagattcccttttttaaaaaacggggctctaaccttgtgctacccttttttgggcgtgcct

SEQ ID NO: 457634 - DNA, 948 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagaggttggtgtgtgggtgggaactggggacccaggggtggtgatgatgaagaccagagcggggttcgggggccgcctccgcctctttcgttctctgctttcccctcccccctcgcgctctctccctcctcccccccatctcagtgccgggaagccgcctgtgctgcgcctggtggggaaatggtggacgctcatgactgtgtatgtgtttttgtatatctgtctgtctgggccggtctcgggggacccctaagggtgaccgtaaggcgaaaaacgtttgaaaaccacggccctgagttaagaaaaacagatactgaaaatagtggtctgagtgctggtctatccattcaggcactcagtctccactgcctgattgtctgtaaggggaggccccaagtgaattttatctgtagagtcacatctaggcaaatgcgtgcttgacaaaggcgcccaataaattactttactgaatagagtatttgaataatgtttatttttctgctgataacaacaatctacatattcaatttcgaacatttgaaaaataacaatatagtataaaatttaaaaatacacataattcaccacccggagacgactgctcaacctgatgtcgttacagttttttaaaaaatgtgtataacacacatataaatacacaaattcttaactcacaaagagtcctggttcccactttagccagcagtcctgatggccttcccaggagacgcagtaatgaagtagaacctctctgcccctacagaagggctcttaaggaatagagcggtgcagggaattaaatgggacgggttatcccagggataaggcaagca

SEQ ID NO: 457635 - DNA, 2307 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457636 - DNA, 2251 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctcctttttttgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457637 - DNA, 2255 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagcatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457638 - DNA, 2337 bp, Homo sapiens
gtaattctgttgcgatcgtgcataccgctctcggcttatatgccgttttgacccggaagaacgagagtaaaatttaccctgagttcattgcgttagtactctagcaccaatagagttgtattgatgcactaatctatgctcaccaagatcccatataatgcatccatgaactgctgatgctatctggaaggcagaggcacgtgggttcgtcgtctagataaggtcaggtgcctatcctgagtcttgttccatcctctgatctgatgcacatcttctctagatttgcatggatccattatgtgctcatcagtgtattcgtttgcattctatctaccagaagagatgcgcacgacccatagtggtcgacctcgttaagtagagggttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457639 - DNA, 2505 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaaaaaaaaatttctttcttactcttttatatattcacttatatcttttatccttaacaatatccaatatctttttctaatcttattcttcttaattcttatatttttattatcatctattttcaatttatcttctctataatcttatctactaataacaacatttttttgtccctctctgccttaattcttttattctat

SEQ ID NO: 457640 - DNA, 2269 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtattcggggccgggtcttcccggttggagtccctaaagttggcaaaggactggggctcttgcgggc

SEQ ID NO: 457641 - DNA, 1242 bp, Homo sapiens
  misc_feature (17)..(17): n is a, c, g, or t
gggctgcaggaattcgncacgagcagtggctctgtaaggtaaccccctcatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457642 - DNA, 2249 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457643 - DNA, 2291 bp, Homo sapiens
ggtcatgtgaatatagaaatagcaattattgcgcgaccggtatgtctgttacgatctcagctatagcagtttgagggaagagaaatacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457644 - DNA, 2253 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccgtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaa

SEQ ID NO: 457645 - DNA, 2326 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaatcttgaact

SEQ ID NO: 457646 - DNA, 2278 bp, Homo sapiens
agcggaggcgctcacgtgattactcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatcataccgatctgcccctccgccctcagtccttccccgtcctgccgctccccgcccccagcgtacgcgcgagt

SEQ ID NO: 457647 - DNA, 511 bp, Homo sapiens
agcaaaaggatgtcctctctcccaaaggccttctgcgtttaagcaatgcttgttgaagaaatgttagcctgtggttatgatcttatgcacaaagataactggaggattcagcaccgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatcagtccccttgtctgtcctcccccacttcttgaataaaataatttaaagagaa

SEQ ID NO: 457648 - DNA, 580 bp, Homo sapiens
gcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggagcaggggagggccgagccggcggtgagaggcacgagaagggccccgatatgggacatggacggggaagcactgcagggagccgtggatccacggagtggggcacccgggggccaccagatgacagaagcggatggcggcaggtgcagaccagcccacactaacgcaagacgccagtacagagcaggcgaggccgcagcagcagactaagggaaataaaggaacagagaaccccagacacaacaagacaaaaccatgacaacagcaaca

SEQ ID NO: 457649 - DNA, 2949 bp, Homo sapiens
gcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagttcagtccccttgtctgtcctcccccacttcttgaataaaataatttaaagagaa

SEQ ID NO: 457650 - DNA, 1758 bp, Homo sapiens
ggcctgtactcacttctgacttagtcctgcgccactgtcctcagctctgtgtcccagccacactggcccccttgtacttccgtgccccccagtaggtttgctccagcctcagggcctcggcactagctgtcccctctgcctggaacgctctgctctgtacgcccacctagttaaatcctgatcattctacagggtacttcctctgggaagccttcctgggtgtctccaggccaggccggggtcctcccgcagtgtagagtgtctgtgcccaacacgagcttttgctggcactcactgctgtctgctgcttttgtcttccccgttgggttaagcagtgtgtgtgtgagcggcacccagtgtatcccatccctgttgtgtcccagtacttagtgtggggctgtgcatacagtaggcaccaactaagtgcatttagaacaatgatgaaaacaaaagcacaggtgggtggcgggcaggctgggtggagggaagatgggcctccagccatgttgggggagggggtggctggctggactcggcgtctgtccccaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgagtgcctgctgaggctggccctaatgagtgatggctcccgtgtgcccatgccccgtcttgtgtccgtagtccctgatttgctgacgtcgcatgcgcccgtgcgtgctgctgtgtgctcctagcccgatgtggaggagtgtgtggcccccgggaaggggggacgttcacagcggcagtgagtacgaggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 457651 - DNA, 1831 bp, Homo sapiens
ggcctgtactcacttctgacttagtcctgcgccactgtcctcagctctgtgtcccagccacactggcccccttgtacttccgtgccccccagtaggtttgctccagcctcagggcctcggcactagctgtcccctctgcctggaacgctctgctctgtacgcccacctagttaaatcctgatcattctacagggtacttcctctgggaagccttcctgggtgtctccaggccaggccggggtcctcccgcagtgtagagtgtctgtgcccaacacgagcttttgctggcactcactgctgtctgctgcttttgtcttccccgttgggttaagcagtgtgtgtgtgagcggcacccagtgtatcccatccctgttgtgtcccagtacttagtgtggggctgtgcatacagtaggcaccaactaagtgcatttagaacaatgatgaaaacaaaagcacaggtgggtggcgggcaggctgggtggagggaagatgggcctccagccatgttgggggagggggtggctggctggactcggcgtctgtccccaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagccgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 457652 - DNA, 725 bp, Homo sapiens
  misc_feature (8)..(8): n is a, c, g, or t
  misc_feature (146)..(147): n is a, c, g, or t
ttcctccncagcgtcagtgccgagtacacaggccacggtgtacaaagaacccagcgccaagtccacaagttcatcatcccaatgccttcacactgctgcgggggggggccccggggggggggcccaaaaaaaaggggttgaacgannaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 457653 - DNA, 3001 bp, Homo sapiens
gcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 457654 - DNA, 1876 bp, Homo sapiens
ggcctgtactcacttctgacttagtcctgcgccactgtcctcagctctgtgtcccagccacactggcccccttgtacttccgtgccccccagtaggtttgctccagcctcagggcctcggcactagctgtcccctctgcctggaacgctctgctctgtacgcccacctagttaaatcctgatcattctacagggtacttcctctgggaagccttcctgggtgtctccaggccaggccggggtcctcccgcagtgtagagtgtctgtgcccaacacgagcttttgctggcactcactgctgtctgctgcttttgtcttccccgttgggttaagcagtgtgtgtgtgagcggcacccagtgtatcccatccctgttgtgtcccagtacttagtgtggggctgtgcatacagtaggcaccaactaagtgcatttagaacaatgatgaaaacaaaagcacaggtgggtggcgggcaggctgggtggagggaagatgggcctccagccatgttgggggagggggtggctggctggactcggcgtctgtccccaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 457655 - DNA, 1019 bp, Homo sapiens
gtgctgcagagggcagggggtcttgggcaggactgactcctcctgtgttccccccacagcctgctggaccgggtgttgtggagggcaggggcttctggtgggcactgacctgcaatctctgtccccaggctctcgctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 457656 - DNA, 621 bp, Homo sapiens
gactttcacttccaatggagtcaaaattcattggaatctggaggctttcaggggcagtcctggggaggacctttttataaccttgcagcttgggaactccagcccaagtgtcagccatgacaattacccccaggagggggtctgaaggggagcggagggtgaggctctctcattccagatatggagactaaaaagttcaagatggaagtaatagcaaaaaaattacagtactaatcacaacagctaccatttctcagcattagacacagtaactgtatgaaagaagtatgattattaggtctgttttaatgaggaaactgagacccagaaaggtggaagcacttgtctaaggtcacgcctccaggaagcagtgtgtccacgactccagtccaagtggtcaggctccagagcccacagtcccaggtactgggtggcctccagagtaaacatgcacatttattgacacctggacctcccaaagtgctaggattagaagcgtgagccacctcgcccagccggaggaagggtatcttaagcagagggaaaagcatgtgcaaaagccttcaggcggaagtgtgattggcacttttgaggaacaagcaagaccagtgttaggcactg

SEQ ID NO: 457657 - DNA, 3126 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457658 - DNA, 2056 bp, Homo sapiens
ctgcctcagtttctctctagggaaaaggacgcagttggtgtggagcagggcatcggtggtcctgtcaggaagagtggcgcgggtgccgatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457659 - DNA, 2946 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457660 - DNA, 2620 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctgggatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457661 - DNA, 3043 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457662 - DNA, 2824 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctgtgagggcgctggggtgtccgagcgagcagggaactctggaaggggacaggagccgggggagctgcaggcggccgct

SEQ ID NO: 457663 - DNA, 2337 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457664 - DNA, 1968 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccgagctggccgggcccgggggcaggggtccgagggtcggcggggccggggggggagggtggggtgggggggggggtgctgggggctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457665 - DNA, 1867 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457666 - DNA, 3141 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457667 - DNA, 2276 bp, Homo sapiens
gactttcacttccaatggagtcaaaattcattggaatctggaggctttcaggggcagtcctggggaggacctttttataaccttgcagcttgggaactccagcccaagtgtcagccatgacaattacccccaggagggggtctgaaggggagcggagggtgaggctctctcattccagatatggagactaaaaagttcaagatggaagtaatagcaaaaaaattacagtactaatcacaacagctaccatttctcagcattagacacagtaactgtatgaaagaagtatgattattaggtctgttttaatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457668 - DNA, 4177 bp, Homo sapiens
cagtagagctggggtttcaccatattttctttctttctttctttcttttctttctttctttctttctctttcttttcttttcttttctttttctttctttcttttcttctcagagtctctctctgtcacccaggacaacagagtgagacgctgtctcaaaaaaataaaaattaaaaaaaaagaaaaagaaaaactaaaaaggaagatgtggccctatcttgccgagctcattcttctgtgtgtccccagcccctagcacaaggagaaacagaatagatgctcaagacacaaaggcatgtctgtgcaagggtgcttgatgacggttggaggggcacaatgactttcccaagatcacacagcaaatgtgggacaaaatcaaggctgacagctcatgacagggtgggaggcagatgcagctgcctggcacaggctggctctccagggagatgggcagtgggcacgcattgcccagggcagaactggggctaggggaggaaacaacaagggaggctgtcattagctccttccaaagtggaggtcacttctctcccaaccccgagtcctccacccaaactcccttctcaaggtacaagggctgatcccgtaccagggatgggtagggactcaaagaggaaaagaggatgaaaagaggatggggactgagtgagatgtgaggactccagagggattagcggctctcaaggcaagtgggaggggacttcccggtaggagcccggagacagatgggagcctgtgaagagggcgggggcccggcgaggagaagcggtttctacgctggggtggggctccatgagggggatggagacctggaaaagggactgacggtgcagcgaggagaggaaggctcggttaagggatgggtcttccacgggaggggtggggaactgcgggagtgacggcagcttcggtgaggagtctgaggggctgcgtgaggggctggggcccagggagtccgaggggtctctgtgagggcgctggggtgtccgagcgagcagggaactctggaaggggacaggagccgggggagctgcaggcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactgaaaaaaaaaaaaaaaaaaaaaaaaaaaaaaaaaaaaaaaaacaacaaaaacaaaaacaaacaaaaaaaacaaaaacaaaaacaaaatcaagagagcgcggcagagacgacagaagagcacgcctctaggaggtagagaagcagcgaacaacagccacgccacgagaccagagctagcatcgacgaaagggcagctgtcgcctaaatagacgaagcgcaggtatataagacaggaggcgggaggcgagggcgaggcactaccatacacaccacaactaacacacaaacaccgacagcaatcaacaaacaccattccgcacatcaattgtccttaccgttcacgcttcactctacacacacaaaataaatataaaatagaatacacctgataatgaatcactcactccacaccaccacaccaaccctactacactacacaccttcactactcagctaaccaataccaacagacccagaactaagcacatctatgacacaataaaacatcaagcaatctaatcccaacacctccctcaatcccagtaacactcatcaccacacaaaaataatcctatctcacacacacacaaaaaaaaaaacgcactacccaccactactaatctcactccccacaccacactctatacacacacctcatacatgataggacggcgagacgagaacaaggttaagagccgaacgacctctcgcacgcgacaggagaaagagtgacagagagcaggcgacgggaagcgcgggcgatggcagagcgcgtgaccgagggtgaggtacgcgagcgcacggaggggtgcgcggtaccacgacatcacccccgcatgctcgcctacacaacgtgttcactttatcactccaactctcattactcatctctaactctaccaaacatcacccactaacttccccagctactcccagtcgtccacacccgaccttgttagtaaccaatactccaataaccatcgacgccttctattctctaattcacaccgtccccctgctacacctcgactccaacca

SEQ ID NO: 457669 - DNA, 1624 bp, Homo sapiens
cacgcctgctgggggtatattgtgttgacgtccgcttactgatgctccgccttactgacgccgcttactgatgctccgccttactgaggtccgctcggaccaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttcccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 457670 - DNA, 718 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccag

SEQ ID NO: 457671 - DNA, 798 bp, Homo sapiens
accatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacgtcgctttcctcttctgtttttcattaggacatg

SEQ ID NO: 457672 - DNA, 858 bp, Homo sapiens
tggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctatattacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtgattagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttga

SEQ ID NO: 457673 - DNA, 395 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaggacaagaaggctgtcggggggagcaataattttggcaagtcagagggacttggggagca

SEQ ID NO: 457674 - DNA, 2907 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457675 - DNA, 2719 bp, Homo sapiens
cgtaggctaggtcgagccggtgtgatcggccgaggcatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457676 - DNA, 2770 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcgagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457677 - DNA, 2778 bp, Homo sapiens
tggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctatattacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457678 - DNA, 2549 bp, Homo sapiens
gacccccacctgctgatctatagcgtcagcagtttgtctctgggggtcccaggcagggaaggaagagggtcttaagaggcgtcaggatgggagtggtgaggacggtaagagtagagagcctccaacctgaaaatgtgacctcttacgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457679 - DNA, 1748 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcgcccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457680 - DNA, 1303 bp, Homo sapiens
cagacaggccatgtgagccactgctgccagcacagagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457681 - DNA, 454 bp, Homo sapiens
cagagggcagacatgctacacatcacaatgatgagagctgcggattctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457682 - DNA, 179 bp, Homo sapiens
ggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggt

SEQ ID NO: 457683 - DNA, 2936 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457684 - DNA, 533 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaaggg

SEQ ID NO: 457685 - DNA, 2952 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaaaaaaaaaaaaaaaaaa

SEQ ID NO: 457686 - DNA, 3122 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaagagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457687 - DNA, 2893 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggtggaatctcactctgtcacccaggatgcagtgcactggcgtgttctcggtctcactgtaacctctgccatctgggctcaagtgattctcctgcctcagcctccggagtagctgggattacagagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 457688 - DNA, 1016 bp, Homo sapiens
gagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttga

SEQ ID NO: 457689 - DNA, 1124 bp, Homo sapiens
cttgaattatttggtttcgtttgttttctattagactatggtgagctcaggtgattgatactcctgatgcgagtaatacggatgtgtttaggagtgggacttctaggggatttagcggggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatgg

SEQ ID NO: 457690 - DNA, 684 bp, Homo sapiens
tgattattctttgggtggatgaaatactggctatgcattttaagcccaagagaaagaagtcagagctgataccatcatcaccttgctttgccctcataggtcctttaaactaaaaatgccttcgttcttagcaattgtgattctacgttcttcccagtgtataaaagatgttattttcacatacctttttgacttggtagaccagataattatttctattccttgtacctgttttgtaattttctttgatacacaggaagtcaagtcataggaggcaaataatttaaatacttaaaatagttttcaaaatatcctcaataaaagtgattaaaaattaatgaaagctacatttaatgcataatatgtatttctgtacttagttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggtaagaatagctttttaatgtgaatttttcaagctgaacatttatgagataatactagataagtatcttatttcctaaaatattttaca

SEQ ID NO: 457691 - DNA, 685 bp, Homo sapiens
gttggccatgctgacacctgcgtgttctttttttcctcagaagttgagatgttatttttaatggtgtgcttaataatactcaatttacatttttttgtgagatgtcttttgctttacggttaataattctaaatgagactaataatagctacatatcatacttgctgtgcgtcccaagagtttttaagagatttgcatgttaattctcatagtaaccatgtgaggttggaactaggattacttccatttcataaagaaattgagctacagagaggtcgtataagctacccagatcactctgctgttaagtagtgagcaagagatccactgccattcctcaggagaataggcctttaaaacaataatatatagaactgaaagcaccaactgtcctcttaggttatagctcctgatatctcctaaaattttagcttttcgagggggaagtgggcgtgcagtggtgagcacgtggggactcttcctaaagccttgattcttagcatggaatcagttttgtgtttctctttatgttaacgtaggttatccaggtacctcaagggaagtactcccggacagttccaggaatattattagaagtactcaccacattatctgctgtatcttccattaaacacattccttttttacccccttttgaatctggactccctactctatacattat

SEQ ID NO: 457692 - DNA, 437 bp, Homo sapiens
ttctttgcaaaagatgacagaacatcatttcttcttcatggtggggttgtccacatataatgcatgttttacatgccatccttcttgcctggatatgacaatggagcttgtttctatgattaagacctacccatggcagtgtatggaatgtaaaacatgcatttctttattgctcataagccaccacaaccagaagagaaaatattttagatagaaggaatggtattagcaaaggttcaaaagtagggaaattcacaatatcagcagaggaaagtgaaattttgtcttattggatatagagaacctcagatgctttttgagcaattcagtgacatatgtaagctgtatttttggctaattaatctggctgtttttttgtaagcactgtttgtacgcaggcagagactgatgagggatatagaaggtagtacaataca

SEQ ID NO: 457693 - DNA, 4211 bp, Homo sapiens
tagtgaatttttctaagtatagattcttttattagacatgcaaagagaataatcacacaactaagttttccacaaacgtttatgtacacgccaatgtatgcatgagacatctttcaattaaaaatgtttaaactgatttttttttaaataccactataccaatgaggataagctgattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457694 - DNA, 4157 bp, Homo sapiens
tagtgaatttttctaagtatagattcttttattagacatgcaaagagaataatcacacaactaagttttccacaaacgtttatgtacacgccaatgtatgcatgagacatctttcaattaaaaatgtttaaactgatttttttttaaataccactataccaatgaggataagctgattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctttttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457695 - DNA, 4685 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457696 - DNA, 4391 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457697 - DNA, 4158 bp, Homo sapiens
tagtgaatttttctaagtatagattcttttattagacatgcaaagagaataatcacacaactaagttttccacaaacgtttatgtacacgccaatgtatgcatgagacatctttcaattaaaaatgtttaaactgatttttttttaaataccactataccaatgaggataagctgattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggaatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457698 - DNA, 4158 bp, Homo sapiens
tagtgaatttttctaagtatagattcttttattagacatgcaaagagaataatcacacaactaagttttccacaaacgtttatgtacacgccaatgtatgcatgagacatctttcaattaaaaatgtttaaactgatttttttttaaataccactataccaatgaggataagctgattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaatgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457699 - DNA, 3348 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457700 - DNA, 973 bp, Homo sapiens
tagtgaatttttctaagtatagattcttttattagacatgcaaagagaataatcacacaactaagttttccacaaacgtttatgtacacgccaatgtatgcatgagacatctttcaattaaaaatgtttaaactgatttttttttaaataccactataccaatgaggataagctgattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagcgctggatttgtgactgtcgggctagtcgggg

SEQ ID NO: 457701 - DNA, 1934 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatgg

SEQ ID NO: 457702 - DNA, 466 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttgggtactgtcattttatcggttattaatattttttgtgatgttcctctttgccttaacatcctcttccctttcccccagctctggcaaaggcaattattaaaaattgtagaatattttcttcctgttctataatgtgccatcaaagttggtcttgctactgagtgtaattaaaaagcaattttatgatagtaaaatacatacatacataaaattaatcattttaacaatttttaagtgtgaaattcattggcatcagttacattcacagt

SEQ ID NO: 457703 - DNA, 400 bp, Homo sapiens
tggtgagcacgtggggactcttcctaaagccttgattcttagcatggaatcagttttgtgtttctctttatgttaacgtaggttatccaggtacctcaagggaagtacaaagttttgccaacagagcgaacaaaggtcagttcttacccagtggctctcatccccggacagttccaggaatattataagaggtatttagtagttttagttacagttggtatcggctattggtaaggggtttcagagccttttgtacttgcctcctaacaattttggggtctatagatatcaccgtaagatatcgtataggatttgtgttgctattcttctctggttctgtggtaaacaataccctgtagtcagaatttgaatatatgctggtgaagtctagatgcctctg

SEQ ID NO: 457704 - DNA, 4782 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattccgtaagtaattgaggtgactggcattttttatttgggttggggaaaatgacattttagaaagttatatgtgacttccaactgtattttttttttccagcaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcagtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457705 - DNA, 3159 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcgccgtcggcggggtaggcggcctcgccgaacgggtgctgctcgaccgtgccgtcgtagtacaccttcatctcgaactcgctctccaggtgggaggggtgtccatagacgccgatgcccactgggcgccggaagtgcgcggggatggacacggcgtccgggccgcaggtggccgattgcagctcgtagtcgtcgaagctggggtgcaggctgctggcggagacgtacagatccgcatctcccttgaggctgcgcatcctgaggactatcttgccctcgtggttcagccgcaggtagctgtagttcccggcgcctatctggccctggacgacgtgcaggagcacccactcctcggggacctcctcctcgtccgcgcagcttcccggagacaggacctgcgaggctaggagcagcagcagggccgtcgtccagggcgcggccctcccgcggggagcggccatggctggcggctcagctccggggcctgcaagtgggtcagtgctgctggggacaccggaggcgctcagcaccggagcctgtccccgccgtccgcacgcgggtccacggcgcgtccaggcgcctggtctgtcgctgggactgtcccttcccacccgcgtgaggccccggggaggaggggtgggttaacccctcccccgtagcgcggcgcccactcagggcaggggcaggggcaggggcagggccgctgtggcaccctcggactcaccaccactccccgcagggggccgcgctttatacatccggacc

SEQ ID NO: 457706 - DNA, 1350 bp, Homo sapiens
gctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtgccatccttcttgcctggatatgacaaggaggctgtttcttaagttgctatgcctcagtttcctcatctataaaatggggggaaataataacggactaccttgtagggttgtcttaaggattaaa

SEQ ID NO: 457707 - DNA, 1860 bp, Homo sapiens
  misc_feature (9)..(9): n is a, c, g, or t
gaattcggnacgagagagagagagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457708 - DNA, 2221 bp, Homo sapiens
ttttttttggaccaagtctcgctctgtcgcccaggctggagtgcagtggcacgatctcgactcactgcaacctctgcctcccgggttcaagcgattttcctgcctcagcctcctgagtagctgggaatacaggcgtgcgccaccatgcccggctaatttcgtgtttttagtagagacggagttttaccatgttggccaggctggtcttgaactcctgacctcaagtgatctgcctgccttggcctcccaaagtgctgtgattacaggcgtgagccaccatgcccagccatattcttggtgaatttcttactgccattagacattacttataaagtctatgacttaatcttttgtgacattttatgcatttctctcttgcctccagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457709 - DNA, 2095 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtaggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457710 - DNA, 2097 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttaattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457711 - DNA, 2097 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctcccaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457712 - DNA, 2191 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccagtcagtgaatgccgtcactttgcagcagtgtctgatggtgtcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457713 - DNA, 1395 bp, Homo sapiens
acctcgggccatcttatgtgaaaaaaagagggaagaggtcagagaatgggaggtacctaggaactgaagtactgggtaaattagagccaaatactgaatccaagagtgaggcagatctcactatacagaccggaatatctcactatcagatcgataggaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457714 - DNA, 1023 bp, Homo sapiens
ggaccggctatcacattatccactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457715 - DNA, 1182 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatattttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457716 - DNA, 918 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttatatctattaatctcaaagaaacataagttgtgaatgtacagttcagaaaataaaaatggagaaactaatgacattatgtcgacgcggccgcg

SEQ ID NO: 457717 - DNA, 969 bp, Homo sapiens
ggaccggctatcacattatccactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaatgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457718 - DNA, 805 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacacacaacagcaaagggtctttggtcctcttgagctctgttctagtgcatgacctgggacgactatactgaaagattttgaagcgggattgttgctttctgagatccatcgatcctgttccacccggttacagtgatgtccccatatcgacggctcaacatgttttggtaactgggggcctt

SEQ ID NO: 457719 - DNA, 808 bp, Homo sapiens
  misc_feature (633)..(634): n is a, c, g, or t
  misc_feature (636)..(637): n is a, c, g, or t
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccaaaaaaaaaaaaaaaaannannaaaaaaaaagagaataaaaaaaaagggggggctttttgtggggggggaaaaaaggagttaaaaaatgggctgtttaaaaattttttcgggacacccttttttaaaaggggaaaaaggcggccccaaaagagggggataaaattgaaaaggggtacggtaatgtgagaaaaa

SEQ ID NO: 457720 - DNA, 2151 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457721 - DNA, 2598 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacagtattctgtgttttatatattgacagctaatccacattttttacacaccaactttctgttcttatttgacatgagacatgttcatgttttctgagtatttatacctattacgtctgttactttttaattctataaacttgaggatagtgaatggtaccaagttttagtttctgcataggttttccagtgtggcttctctgatggatcagtgctaaaatcttaagtatttttctatttgggaaaaaagggttgaattattttcacttgcccacgtagtttatgaatgtgggaaatagcttcaaagacagattaaatgatttgcccaaggccacagaaaagagtgaaaggtggaaccggagactagatcaccacctgtagaaactgttcttcctctgtgaaactaacggcctgctggtaataaaagtagctaccatttcttgaaaaaaaa

SEQ ID NO: 457722 - DNA, 2343 bp, Homo sapiens
  misc_feature (2168)..(2169): n is a, c, g, or t
  misc_feature (2171)..(2172): n is a, c, g, or t
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacagaaaaaaaaaaaaaaaannannaaaaaaaaagagaataaaaaaaaagggggggctttttgtggggggggaaaaaaggagttaaaaaatgggctgtttaaaaattttttcgggacacccttttttaaaaggggaaaaaggcggccccaaaagagggggataaaattgaaaaggggtacggtaatgtgagaaaaa

SEQ ID NO: 457723 - DNA, 2097 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaatgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457724 - DNA, 2126 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggttttgtttcttttgggtctttcttttttggcacatgtgaatcttgtttgtgtaaaatgaaattactttctcttgttctctgatgatgggtttaaaattaaaagagcatccggttttggtatggggatgatccaggattatgttgtgactgatacatattagttacttgtgctttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacag

SEQ ID NO: 457725 - DNA, 958 bp, Homo sapiens
  misc_feature (850)..(850): n is a, c, g, or t
  misc_feature (879)..(880): n is a, c, g, or t
  misc_feature (912)..(912): n is a, c, g, or t
  misc_feature (946)..(946): n is a, c, g, or t
  misc_feature (958)..(958): n is a, c, g, or t
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccattttaatttttcctgaaactggtacaanttcacaaactttaaaggttttccttttgnngatttaattagattatttgggggggaaaaaanccccctttttttaagggaaaaattttttatgggnaaattttgacan

SEQ ID NO: 457726 - DNA, 951 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttcgcgcaggggttttccaactcagcaagttatgtttcgtacgagaagtatagagattggagtgcatgcagcttgactatagaaaatatccttccaatatgatcacttacgggctatgagttctctgg

SEQ ID NO: 457727 - DNA, 378 bp, Homo sapiens
ctggttggccctactgggaaaaaaaaaaaaaaaaaaaaagggcggcggtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggaggtgcgggctagctgcccgcagctgaggcttggtcgcgtggccactcggggattggtggcacct

SEQ ID NO: 457728 - DNA, 699 bp, Homo sapiens
  misc_feature (545)..(545): n is a, c, g, or t
gcttttctaaaaaaaaaaaaaaaaaaaaaaattggcggccgctccaactcagaatagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgcaaaaaaaaaaaaaaaaaaaaaaaaaaaaaaaaaaaaaaaagggggggggggtaaaaaaattccccgggggggccccattttgggtcccccgtttttttttgacccaagggcgcgcccaatagggggggggtattaaagaggaaaggggcggggcccgggttaancaacgtgcggtggggaacactcggcgtggggttctgtggaaggcccctcttcgtggggtgcacctattgggaccactactcaagagatagtcacggaattaacttacgtgtagcttgaacaacggattccggaaaaatcgtcacggtgttgatg

SEQ ID NO: 457729 - DNA, 660 bp, Homo sapiens
  misc_feature (628)..(628): n is a, c, g, or t
aaagaaggaaaccacaacacagaacttgcaagcaaatccacgctcccacatcccagggggcaaaaatccaagaggattgagagaaatatcagaaaaccctcttattcctactgccagcactggcctggggtccagacacttccaaggcctcctcaccacatccagggaggtggccccggctccacttccacagtaggaggacctgaggctcccacactggggtctttgcccttgtccagggatgcgtggtccatgctctgctgctccaagtctcagtgcatcaaccaccctgcctctctctgcaaggaacccacgcggtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcaaggaacccacgcgcgtgggttccttgcagagagagaagcctaaactgctaatctaccaagncactgtacagagagccacgcggggatcctcta

SEQ ID NO: 457730 - DNA, 390 bp, Homo sapiens
gttctctctatagtggagggtgtataaagcagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctacgggggatatggagatgaagaaaacataacccttctgcaaggaacccacgcggtgcagaccagtgggcaaggcagctgggccagatctcaggccagccgtttgtgctcctagcagggttgctgtgctggccacacggagaggccctagagagcctcatggattgtaactaaagagcgtgggttccttgcagatggctcctagccttcataact

SEQ ID NO: 457731 - DNA, 5744 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457732 - DNA, 5603 bp, Homo sapiens
ttctgagggaaagccaggcgtggtggctcacacctataatcccagcactttgggaggccgaggcgggtggatcaactgaaatcaggagttcaagaccagcctggctaacgtgatgaaaccccgtctctactaaaaatagaaaaattagccaggtgtggtgacacacacctgtaatcccagctcttcggaaggctgaggcaggagaatcgcttgaacctgggaggcagaggttgcagtgagccaagatcatgccattgcactccagcctgggcgatgaaagtgaaactctgtctcaaaagacgacaacgataaaaaaaacaaagttctgcgggaagaagacaactagagacatgctgttggccacacatagtgctcttggggctgcttaagtctgtggagttctggggaagaaggtaagagcgatggctttgcaggagctctagtgattgtcgctacttcagttgatgacatgagattgttctttatttttcttcagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457733 - DNA, 6061 bp, Homo sapiens
  misc_feature (5907)..(5907): n is a, c, g, or t
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgcaaaaaaaaaaaaaaaaaaaaaaaaaaaaaaaaaaaaaaaagggggggggggtaaaaaaattccccgggggggccccattttgggtcccccgtttttttttgacccaagggcgcgcccaatagggggggggtattaaagaggaaaggggcggggcccgggttaancaacgtgcggtggggaacactcggcgtggggttctgtggaaggcccctcttcgtggggtgcacctattgggaccactactcaagagatagtcacggaattaacttacgtgtagcttgaacaacggattccggaaaaatcgtcacggtgttgatg

SEQ ID NO: 457734 - DNA, 5690 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttggttctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457735 - DNA, 6021 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgcaggctggtgtggccgaaacaaatacacacagcaacaaccacaacaaaccactttttggggcggcttgggcctcaagaagaaagtttataaacccatcttcgtgggcggcggcgcccaagataggtatttagacatggcgacacgcgtggcccaagagaccgtggcacggaaagggcggggttcccacaaaaaaaacgcgctgcggaccggggttctagaacatccaagtggtagcgcatcgggccaaacagaccaagagcgacatcgcgcggagaggg

SEQ ID NO: 457736 - DNA, 5610 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcaaggaacccacgcacacacacctctgcaaggaacccacgcacacacacctctgcaaggaacccacg

SEQ ID NO: 457737 - DNA, 5619 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgtccccgtacatcgttagaagcttgaattcgagcagtagtagtagtaggcggccgc

SEQ ID NO: 457738 - DNA, 1178 bp, Homo sapiens
accttatccgagtaacactgttctcaaatgtttaaaaaggacaggtgaagtctggctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457739 - DNA, 924 bp, Homo sapiens
agcgcgggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcgtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457740 - DNA, 882 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccaggtaagtaagtaaaattttgttttcatttttgaactttgaatacttggtatattttcatgtcactaagaatgctttctattgacaaacgcagctcaaagtggcttagacaagaaagaaaatacctggaagtgaaaaatcaaatgataggactggatttggtcaaaacttgatctagtggctccagcagttgggaccaggatctagtttctctacctcctggtctcagcttcgcttcctcagtatta

SEQ ID NO: 457741 - DNA, 1822 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggtatgtgctgggtggtaaaatgctttgtacgtacagctgggagagaaaggtgaaggggtggattttgagaggggtgggtatagaattaggacttggttgagtcgatttctcaagttcattaagttagcctgttgataagtgcaacaaaagcttaattcttactgcactgaagctttatatactgtgtttctcatgtcctcccacaaggcaaatctgtaatcactaggttgttaactctgccagagcatctgttcatgaaatagtatcacctactagaaattgaagaatttcttgccatgccaacaggtggaatttccatgttaatgtttttagagataatttttggttagactactttagcactctgataatattttttaaaaaagtattattttccatgtaatgtatagatgaatatttttagattttggaaatcactgttaatattaaaagtggaattggtttgggtctgaatcttgaggagattggttatttagtgggatttcctgctaggagcctgcactctctggtgttggttccttttggacttttttcacccacacggggctttgcctttctgccgcagcagtggtggtgcacactctgatctgaggctgtggtttggccttaatcctgggactgctggggcaactttatccctcaacagtagcttcacacagttaactttgacagaggaggagacaacagcagtgtcctttccccagattcttcctgttttgttaatcataaaattctgcctttatattctgtccttacatccatctcttcgtttccatttccacttccactatgaccctatatgaccacccttgttcagaccgtagttcacaccctgagaaaaacgttcttgacttggtcttcctgctcccaagctttctttccccgggttagtgttcttcccatttaaaccagagcgatgctcccagatgaatttttctcagtggtttcccatgactgtgagacacagttatgcctagagtctcgactttcagtccctagctgtttgccatattggcccattttttccctttagagtggttttccttttgtgttttgccttgaaagaaccatccatctcgt

SEQ ID NO: 457742 - DNA, 1681 bp, Homo sapiens
ttctgagggaaagccaggcgtggtggctcacacctataatcccagcactttgggaggccgaggcgggtggatcaactgaaatcaggagttcaagaccagcctggctaacgtgatgaaaccccgtctctactaaaaatagaaaaattagccaggtgtggtgacacacacctgtaatcccagctcttcggaaggctgaggcaggagaatcgcttgaacctgggaggcagaggttgcagtgagccaagatcatgccattgcactccagcctgggcgatgaaagtgaaactctgtctcaaaagacgacaacgataaaaaaaacaaagttctgcgggaagaagacaactagagacatgctgttggccacacatagtgctcttggggctgcttaagtctgtggagttctggggaagaaggtaagagcgatggctttgcaggagctctagtgattgtcgctacttcagttgatgacatgagattgttctttatttttcttcagctggttttcccatgggctatgcagcagcagctcctgcctattctcctaacatgtatcctggagcgaatcctaccttccaaacaggtatgtgctgggtggtaaaatgctttgtacgtacagctgggagagaaaggtgaaggggtggattttgagaggggtgggtatagaattaggacttggttgagtcgatttctcaagttcattaagttagcctgttgataagtgcaacaaaagcttaattcttactgcactgaagctttatatactgtgtttctcatgtcctcccacaaggcaaatctgtaatcactaggttgttaactctgccagagcatctgttcatgaaatagtatcacctactagaaattgaagaatttcttgccatgccaacaggtggaatttccatgttaatgtttttagagataatttttggttagactactttagcactctgataatattttttaaaaaagtattattttccatgtaatgtatagatgaatatttttagattttggaaatcactgttaatattaaaagtggaattggtttgggtctgaatcttgaggagattggttatttagtgggatttcctgctaggagcctgcactctctggtgttggttccttttggacttttttcacccacacggggctttgcctttctgccgcagcagtggtggtgcacactctgatctgaggctgtggtttggccttaatcctgggactgctggggcaactttatccctcaacagtagcttcacacagttaactttgacagaggaggagacaacagcagtgtcctttccccagattcttcctgttttgttaatcataaaattctgcctttatattctgtccttacatccatctcttcgtttccatttccacttccactatgaccctatatgaccacccttgttcagaccgtagttcacaccctgagaaaaacgttcttgacttggtcttcctgctcccaagctttctttccccgggttagtgttcttcccatttaaaccagagcgatgctcccagatgaatttttctcagtggtttcccatgactgtgagacacagttatgcctagagtctcgactttcagtccctagctgtttgccatattggcccattttttccctttagagtggttttccttttgtgttttgccttgaaagaaccatccatctcgt

SEQ ID NO: 457743 - DNA, 1226 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggtatgtgctgggtggtaaaatgctttgtacgtacagctgggagagaaaggtgaaggggtggattttgagaggggtgggtatagaattaggacttggttgagtcgatttctcaagttcattaagttagcctgttgataagtgcaacaaaagcttaattcttactgcactgaagctttatatactgtgtttctcatgtcctcccacaaggcaaatctgtaatcactaggttgttaactctgccagagcatctgttcatgaaatagtatcacctactagaaattgaagaatttcttgccatgccaacaggtggaatttccatgttaatgtttttagagataatttttggttagactactttagcactctgataatattttttaaaaaagtattattttccatgtaatgtatagatgaatatttttagattttggaaatcactgttaatattaaaagtggaattggtttgggtctgaattggaggttatacatgggggcctctagagtc

SEQ ID NO: 457744 - DNA, 521 bp, Homo sapiens
agcgcgggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcgagacgaggtttcaccgtgttagccaggatggtcccaatctcctgacctcgtgatccgcccgcactttgggaggccaagactggcggatcacctgaggtcggaagttcgagaccaacctgaccaacgtggagaaaccccgtctctactaaaaatacaaaattagctgggtgtggtggcacatgcctgtaatcccagctactcaggaggctgagacaggagaatcgcttgaacctgggagtcagaagttgcggtgagctgagatcgcgccattgcactccagcctgggcaacaaaagtgaaaactctgtctc

SEQ ID NO: 457745 - DNA, 5399 bp, Homo sapiens
agcgcgggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcgtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457746 - DNA, 5690 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacgaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457747 - DNA, 5689 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttatgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457748 - DNA, 5876 bp, Homo sapiens
ggagtctcgctctgtcgctaggctggagtgcagtggcatgatctcagctcactgcaactttgcctcccaggctcaagtgattctcctgcctcagcctcccgcatagcagggactacaggcgtgcgccaccacacccagctaatttttgtatttttagtagagacggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtacagatgtttgtctcatacgcgttcataagatgctggtgcaaaaaaaaaaaaaaaagggggcctaagtaccgggggccgttggcccgtttggaaggcctagggcgttaaaagaagggggtaacgcggggaacgcccgggttgggcctctgggtgaccccaaaccgaaaagttgacgtgcggtctgatacc

SEQ ID NO: 457749 - DNA, 1201 bp, Homo sapiens
agacccccttaccccacagctctgaccgtaaatgcttcaatgtacagctttctgtcgggctactcggggatatatctggagggtccggagcccgtgggattcctgttttggggtttacgtcggctggtaagtgtggagatgggtttcccggcgtgaagatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 457750 - DNA, 887 bp, Homo sapiens
tagaatgaagattaaataaagatatctcttttaattaaaagaatagttataccagcatcctggaataaaatggggatggttcttagcattgactagagttctcagctttctggcagccaaagcagaaaaagacctgatgaattcatagttatcattgatgacgtatcttcttgtatttgcttccagggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactataggtatagctagaacctgcttcaaaacaaagcttttacctaacagttttcaagcagtgaaaactggaaaggtgctctgttttgcttgacgtcgtgttcatatctccaaggcagaaattctcaaataatcttctgaagtagctgccataaccaataagtggcattatcatctcacttttatcttaaaaattgtgcacagtttgcatcccatttcacaaaatgtccattttgttttaatatgaaaagtaaattttatgttcttttaaaaaaattcctgttctccctggaacatattccttgtggtatatgtatttcagtcagaatacaagggcatggagt

SEQ ID NO: 457751 - DNA, 2579 bp, Homo sapiens
gtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacacaattaagttgctgcaaatcaaagcttagagagaatagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgtctgatttgtttaataaagggaggcttattttaatatctggcatttatttttgttctcccaaatgtttgctttatcttcacagaatggttttgtaattacataggagcttttgggaccactttaggggcaacattgggacatgactagtgttgctggtgcagtggcctcaggaaaggtggggacactgctcttgaagaacagagatggagaccaaactgggcattgatccagagaatgcttggttccaggtcccacttctaagaaagacactacaaaggcatagttcat

SEQ ID NO: 457752 - DNA, 1642 bp, Homo sapiens
gtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatgggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgtctgatttgtttaataaagggaggcttatttta

SEQ ID NO: 457753 - DNA, 1555 bp, Homo sapiens
gtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggtgagtttctcacccgcccagaaagccaattaggcttgcttcatgaactgctttatctgagaagtcctttaaattgcttcgtctgaggaaaagaagagggtaaaggcagttcttaatcagatatgttctagtaagtgaagatgtttgtagaaatagctgtgtcaatgatatttgatagtcactaatctgtcttgagcttattaacaaattgtaaggctgggcgtggtggctcactcctataaccccagaactttgggaggccgaggtgggcagatcacttgaggtcgggagttcgagaccagcctgatcaacatggcgaaaccccgtctctactaaaattacaaaaattagccaggcatggtggcatatgcctgtaatcccagctactggggaggctgaggcaggagaatcacttgaatccaggaggtggaggttgctgtaacccgagatcgcaccactgcactccaacctgggcaacagagtgagactctgtcttgaaaa

SEQ ID NO: 457754 - DNA, 2323 bp, Homo sapiens
gtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacacaattaagttgctgcaaatcaaagcttagagagaatagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgtctgatttgtttaataaagggaggcttatttta

SEQ ID NO: 457755 - DNA, 2269 bp, Homo sapiens
gtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagtatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacacaattaagttgctgcaaatcaaagcttagagagaatagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgtctgatttgtttaataaagggaggcttatttta

SEQ ID NO: 457756 - DNA, 146 bp, Homo sapiens
gggcaggttgttccttgcatgctaagccaggccatgtgaagataatgaagtcccgcctcgggctaccggacaccgtttgtaccatcaggccatcctgtccaagtctcctggggtctttgcctgcttgtttaaacactgaaggccaa

SEQ ID NO: 457757 - DNA, 608 bp, Homo sapiens
ccattttcccccaggaaaccagttagaccatgatttcgattttaaaacgactccccataagggaatttggccctcaagcccaagaattcggcacaaggcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataa

SEQ ID NO: 457758 - DNA, 1031 bp, Homo sapiens
  misc_feature (105)..(105): n is a, c, g, or t
  misc_feature (109)..(109): n is a, c, g, or t
  misc_feature (119)..(119): n is a, c, g, or t
  misc_feature (163)..(163): n is a, c, g, or t
  misc_feature (237)..(237): n is a, c, g, or t
  misc_feature (270)..(270): n is a, c, g, or t
gagatggagtctcgctccatcgcccaggctggatcgcagtggctggatctcggctcactgcaagctccgcctcccaagttcaagcaattcttgtctcagcctccngagnagctgggacnacaggcacctgccaccacgctcggctaatttttgcatttttagnagagacagggtttcaccttgttggtaagactggtctcgaacccctgacctcaggtgatccacccgcctcggccncccaaagtgctgggatgacaggcgtgagcgacngcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagtagcgcagcaccgattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggaatctacttcaccgggtcctcaag

SEQ ID NO: 457759 - DNA, 281 bp, Homo sapiens
taaaattggggcagaacaaatatgtgaagagagagaaagaagaatgaggcagactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacatgggggatacctctagaggcgacc

SEQ ID NO: 457760 - DNA, 2030 bp, Homo sapiens
agtgacctgaggatcccggtgaagtagattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataa

SEQ ID NO: 457761 - DNA, 2507 bp, Homo sapiens
  misc_feature (105)..(105): n is a, c, g, or t
  misc_feature (109)..(109): n is a, c, g, or t
  misc_feature (119)..(119): n is a, c, g, or t
  misc_feature (163)..(163): n is a, c, g, or t
  misc_feature (237)..(237): n is a, c, g, or t
  misc_feature (270)..(270): n is a, c, g, or t
gagatggagtctcgctccatcgcccaggctggatcgcagtggctggatctcggctcactgcaagctccgcctcccaagttcaagcaattcttgtctcagcctccngagnagctgggacnacaggcacctgccaccacgctcggctaatttttgcatttttagnagagacagggtttcaccttgttggtaagactggtctcgaacccctgacctcaggtgatccacccgcctcggccncccaaagtgctgggatgacaggcgtgagcgacngcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagtagcgcagcaccgattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcacaccccctaccccacaaacattttaagaatctatagttaatacccaatgcctgcttggtctgaacccgttgattggttactggttaagccgtggtat

SEQ ID NO: 457762 - DNA, 2417 bp, Homo sapiens
  misc_feature (105)..(105): n is a, c, g, or t
  misc_feature (109)..(109): n is a, c, g, or t
  misc_feature (119)..(119): n is a, c, g, or t
  misc_feature (163)..(163): n is a, c, g, or t
  misc_feature (237)..(237): n is a, c, g, or t
  misc_feature (270)..(270): n is a, c, g, or t
gagatggagtctcgctccatcgcccaggctggatcgcagtggctggatctcggctcactgcaagctccgcctcccaagttcaagcaattcttgtctcagcctccngagnagctgggacnacaggcacctgccaccacgctcggctaatttttgcatttttagnagagacagggtttcaccttgttggtaagactggtctcgaacccctgacctcaggtgatccacccgcctcggccncccaaagtgctgggatgacaggcgtgagcgacngcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagtagcgcagcaccgattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcccactcccgtaccagaatcaagcttatcgaaccgtcgactcgac

SEQ ID NO: 457763 - DNA, 2652 bp, Homo sapiens
  misc_feature (105)..(105): n is a, c, g, or t
  misc_feature (109)..(109): n is a, c, g, or t
  misc_feature (119)..(119): n is a, c, g, or t
  misc_feature (163)..(163): n is a, c, g, or t
  misc_feature (237)..(237): n is a, c, g, or t
  misc_feature (270)..(270): n is a, c, g, or t
gagatggagtctcgctccatcgcccaggctggatcgcagtggctggatctcggctcactgcaagctccgcctcccaagttcaagcaattcttgtctcagcctccngagnagctgggacnacaggcacctgccaccacgctcggctaatttttgcatttttagnagagacagggtttcaccttgttggtaagactggtctcgaacccctgacctcaggtgatccacccgcctcggccncccaaagtgctgggatgacaggcgtgagcgacngcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagtagcgcagcaccgattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataa

SEQ ID NO: 457764 - DNA, 3165 bp, Homo sapiens
  misc_feature (105)..(105): n is a, c, g, or t
  misc_feature (109)..(109): n is a, c, g, or t
  misc_feature (119)..(119): n is a, c, g, or t
  misc_feature (163)..(163): n is a, c, g, or t
  misc_feature (237)..(237): n is a, c, g, or t
  misc_feature (270)..(270): n is a, c, g, or t
gagatggagtctcgctccatcgcccaggctggatcgcagtggctggatctcggctcactgcaagctccgcctcccaagttcaagcaattcttgtctcagcctccngagnagctgggacnacaggcacctgccaccacgctcggctaatttttgcatttttagnagagacagggtttcaccttgttggtaagactggtctcgaacccctgacctcaggtgatccacccgcctcggccncccaaagtgctgggatgacaggcgtgagcgacngcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagtagcgcagcaccgattcctctcgggctcttgggcgctgctctgaggtgaggagcccgctggaggcgggagagctgggggagggggcgcggcggcggcggcggcgggagccctgcgtgagggaacgcgctttcgaggcggaggttaggagcggggagcgcgcccgggtccagcgtcctgcttctccgcttcccgcgctgagctcttcgcctgtcgctgaggcgtcggtgccagctgcgtgaaggatggagagggcggggcgcgaatcctgagccagagactgagtgcttgggggtgggccgagcacttgggggccgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataa

SEQ ID NO: 457765 - DNA, 2764 bp, Homo sapiens
  misc_feature (105)..(105): n is a, c, g, or t
  misc_feature (109)..(109): n is a, c, g, or t
  misc_feature (119)..(119): n is a, c, g, or t
  misc_feature (163)..(163): n is a, c, g, or t
  misc_feature (237)..(237): n is a, c, g, or t
  misc_feature (270)..(270): n is a, c, g, or t
gagatggagtctcgctccatcgcccaggctggatcgcagtggctggatctcggctcactgcaagctccgcctcccaagttcaagcaattcttgtctcagcctccngagnagctgggacnacaggcacctgccaccacgctcggctaatttttgcatttttagnagagacagggtttcaccttgttggtaagactggtctcgaacccctgacctcaggtgatccacccgcctcggccncccaaagtgctgggatgacaggcgtgagcgacngcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagtagcgcagcaccgattcctctcgggctcttgggcgctgctctgagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataaaaaaaacacaaaaaaagaaaaagacaaaaagacggacgagagaaaacaacacggggaagagccgctaacgggaaggggccagccagagaaaaggggggggggggccaaaatg

SEQ ID NO: 457766 - DNA, 2254 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaag

SEQ ID NO: 457767 - DNA, 1808 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaaacaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtttcagactgcctggtagaaggaggtcacttctgattgtcagtgactttgagctgagtgctgaaataaaatgataaacaagtc

SEQ ID NO: 457768 - DNA, 1301 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggaaaacaaaataccaccctccgccagaaaagtgcagaataaaaattttccactagcaaaagaaggaaaaaataaaagatcttgaatagtctcatcaattacatcttcttttgtgggta

SEQ ID NO: 457769 - DNA, 1233 bp, Homo sapiens
  misc_feature (1021)..(1022): n is a, c, g, or t
gagtttgggatggcaggggagcagttcagctcgtgagaatcggttcgaaaccgccaagtcttttgccctccatggtgcacatgtgatcttggcctgcaggaacatggcaagggcgagtgaagcagtgtcacgcattttagaagaatggatgaaagactgagtcttagggaacaaacagccgagagatgaaatgccacagggatgtctaggttcaaacagcaacagagagagaaggagaaattcctgcagatcatcagggagcgatgcgtaactgaactttggaatggatacagtgctactctcagctgaaagcacaaatcacttccatcacgtatatgagattcctcttgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactatgtgggaattgaggtgtagagctgttgaagaacttgcccagggttgcagagctctttcacaggggcagagcatgggctgaacaccagacctgtctcacactaaagcatgtaagaagtgcctttgcctcctgccatgattctgaggcctcctcagccatgtggaactagctgtgtaatattccacaacccagaggagcagcttgaagccagctaaactgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatgctttcttnnaggtataataaagacagtgcctccttccaggacaacggtttggcagatttgcttgataaaggttggggtttgtaagcttggggctcctcagccatgactgaaacgtactatgagcacggcatctaccgggctgttccacatcctccctgtgggactaggggccagggcaatgggaatcagtgcagaaataaagctcatgctgtttgctctg

SEQ ID NO: 457770 - DNA, 1187 bp, Homo sapiens
gtaccccaagctggtttgggtttataccagtttgaaccgagggaccttcagctgaggaacatgtgctctgtgtgctggaagctcctggaggccccagggttatctctgctcacttagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaag

SEQ ID NO: 457771 - DNA, 602 bp, Homo sapiens
ccttctacgtccttctacgtctcatcactgccttctacgtctcatcactgccttctacgtccttctacgtctcatcactgccttctacgtctcatcactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaag

SEQ ID NO: 457772 - DNA, 2794 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaaacaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaag

SEQ ID NO: 457773 - DNA, 2147 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaag

SEQ ID NO: 457774 - DNA, 1448 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggaactaacatcagaatcatctgaatcatccagaatctgtgtattctcggacaaaatcggattcatcaaatgaatcttcagccaacaactgttcgagaatgatgtctccctcacatgcaggaatgctacattttcttggatttgacatttcagtgatggagaactatatattttgtcaatgggcaatccactactaagaacagaagggtatcatagatgatacctcccgttccaagtcgattgcctaagtgtgtgaccaccacacc

SEQ ID NO: 457775 - DNA, 2725 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaaacaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaag

SEQ ID NO: 457776 - DNA, 1312 bp, Homo sapiens
aatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgcaaaaaaaaaaaacaacattctggaaagctttcctccagaaacactcgggggagcaatcctcttatgtgtaaccgggcaccgggtctaccagctttaaaggagcttgccccccccgtggcgaggaatgggccggaaacaaatcaagtggccccaaagggggggaacaatgtacccggacgaagcacgggatgtcaccaagcaagaagtggggacacgtatcgtta

SEQ ID NO: 457777 - DNA, 1665 bp, Homo sapiens
  misc_feature (27)..(27): n is a, c, g, or t
aaggccatcttattatgctacaccatntcgaacacccctctgcgtttaaaaacagtgtcggccggaatcggatgctgagagagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtg

SEQ ID NO: 457778 - DNA, 1934 bp, Homo sapiens
cacactggtcctctaaaccaatcctcacaacaggactgggagacaggtgttacctttcccactttacagagaatgaaacagagtggcaaagcctccgaaggaccctacacttcggacatcgcaaagcaggatctgagtcccggctcctctgtccaaacctacttgctaggctttctttcccatgtctactctatagctggaaaggtcgtggaggacacattttaggccaaccctctcggtttacaatccagagaggggagaccctcagaagccaagcgacatgtccacggctacgcggcgagtgtgtggcaacgtggaaggggagcccgagacgccctggtctctcccttctctcgcaggttcctttctccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtg

SEQ ID NO: 457779 - DNA, 1988 bp, Homo sapiens
cacactggtcctctaaaccaatcctcacaacaggactgggagacaggtgttacctttcccactttacagagaatgaaacagagtggcaaagcctccgaaggaccctacacttcggacatcgcaaagcaggatctgagtcccggctcctctgtccaaacctacttgctaggctttctttcccatgtctactctatagctggaaaggtcgtggaggacacattttaggccaaccctctcggtttacaatccagagaggggagaccctcagaagccaagcgacatgtccacggctacgcggcgagtgtgtggcaacgtggaaggggagcccgagacgccctggtctctcccttctctcgcaggttcctttctccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtg

SEQ ID NO: 457780 - DNA, 2319 bp, Homo sapiens
cacactggtcctctaaaccaatcctcacaacaggactgggagacaggtgttacctttcccactttacagagaatgaaacagagtggcaaagcctccgaaggaccctacacttcggacatcgcaaagcaggatctgagtcccggctcctctgtccaaacctacttgctaggctttctttcccatgtctactctatagctggaaaggtcgtggaggacacattttaggccaaccctctcggtttacaatccagagaggggagaccctcagaagccaagcgacatgtccacggctacgcggcgagtgtgtggcaacgtggaaggggagcccgagacgccctggtctctcccttctctcgcaggttcctttctccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtgaaaaaaaaaaaacacagatacacgcagaaacgaacgaagcatacacacacgtacacaaaccaacgacagaaggaggggcccgcctcggcaataaaaacatcccccgagagaggggccgccggaattcaagcggttcccccacattttgtggaacaacgcgaggcgcccccaatacagcgagcgtccgcgatgtaacagcacgaatcgacgtcggcgccgataaaaaacaacggggagtaagaagacacaacaaggacagcagggacgacagtcggaacagaaacacaaaaatttacgcgcggcgaaagacattggggcacagacacctgag

SEQ ID NO: 457781 - DNA, 6377 bp, Homo sapiens
  misc_feature (56)..(56): n is a, c, g, or t
  misc_feature (136)..(136): n is a, c, g, or t
aaaaataactcatattgtctctgaggttcttttccagtgaagtgtttagtattgcngctatttggagtacaaagttggagcttttaaagaacctgggagttcaaaagtataaggagaaataaatgaaaagcagaantattttgaggcaataagtatagactcaaatctatattatgacccacttgtagcaccacttggaattctaccaataagagatttatttgggcaaactataatggttgttggaaattgcaaatcttagtgtgaattattttagtccagttggtttctttctttctcttacctgaaatgaactatactgaggcaataggagctttgtatagtaatttaggagtgtaaaacaacttagggaaaaggattattaagcaggatgattgggatgacatcatgtgaaatttaggaattggaggcattgggaattgagagggtgctaacaaaggaaaacagcttattttagaatttgtctggaggatgtagaattgaagaagttttggtatttcttctgcagcggccccagtgcccttgaccaggaacatctcttggagtcagtagttttcatgaggctgacctaggaacttggccaacatatgcaacattgttctatttaaaatattccttgaattaaattcgatagtatcaatttaaaacataaagttttcactcaactcctttagaagttagattttagcttgtacttgtctttacctcttctgctgattatcagttgacaacactgagattactttcattttcctgtaagtcattatgaatttttctggtcaaccatgagttatcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457782 - DNA, 5937 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggctgaagtgcagtggcacgatcataggtggtcactacagtctcagattcctgggcttaagcagtcttcccacctcagcctccccagtagctgggattacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgagctcgcacgtggttcatttgcttgtgtcacctgccattctcaggtggagcagcactggatgccaggtgcctttagaatgaccgtatcatttaccctagaggttcatgacgttcctgtctaaggaaatgtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457783 - DNA, 876 bp, Homo sapiens
ctctatccttaatctacagtcagattaaccaatccctcaaaatgtttagttctttaagccgtattcgtagtctaatgttgaagttaatcaatggaaccctaattcaggaattagccaattcttttctgttaatatcagatcaatgtttttaatccaatgctgactgcagttttaagcaattgaagtaatactattttgaaatatatttcagatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtaaatgatgtattgctttacaaattctgttttcataatttgtttttgtctttcatctgtgacagtgtaatttaaaagttgtttttaggcaaagatgtctacttaatcattcaaatgtgaggtcagtttgaatatacctatttttcatatttgtcagttgtcatgtaagtttagaattatgagataggagtaggatattttaatctactcatgaaggagaacagttagaaagtgttaagtattttggcatacattttacaggttttaaatacaatacagaaagcttaaagatgataaagaatgaaggccatcctgaagagtgatacaaacatcactctaaattttgagattatgatttggagttgaagagtaatgatcagtaggactgatggatactcagtctgaataatgtagagtaaacgagattatagacttgtagggctacagagactgtgtgcagttctgaagtctacaggttttcagtctgtgttctggaagatttttcaaggtcagaggca

SEQ ID NO: 457784 - DNA, 5705 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccgtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457785 - DNA, 5990 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtttaacagatcatttt

SEQ ID NO: 457786 - DNA, 5442 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcagggggaaaatccatatttttaaattttttcgggggttgacaaaaacttttaactgttcaagcctgttgcggaaaaattctttggaaaacattttttaacactttttttcggggggaaaaaaagcacctttttttggggggggggggtaaaaaacaggtgttttttcccaacaattttttt

SEQ ID NO: 457787 - DNA, 3013 bp, Homo sapiens
cgatctagaggatcccgtggacattccacgagtcgcactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457788 - DNA, 5402 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagaaagttcgtttctctcatccgtaagcacagggctgtacacagatcctttattggcatctgcatgagaggcctagaaatcggatgttagaagctaggaatcatggctctgagcgccttgcataaaggagatactcactgatactaaatcaaggcatgtaaacaatactgggtaaatcatacctaccagaataaagagtaacatgcactgcttttctttcatctgtattctttcatgcattacctggttgtttaagattattcgaatgcaattcttaactgcattgtgagctattgtaagtcttcactgtatatatggaaaaagtaaatgggtagtcgtcccacaccaatgtgacattttatgataaatgttttaccagcaa

SEQ ID NO: 457789 - DNA, 1232 bp, Homo sapiens
gatcgagccctaccgtgtatcctatagatcagtagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457790 - DNA, 3947 bp, Homo sapiens
  misc_feature (3712)..(3712): n is a, c, g, or t
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggattgcttgagcccaagaatttgaggttgcagtgagctgtaattatgccactgcattccagtctgggtgacagagtaagagtaagaccctgtctctctgtctctctttctctcttttttttttttaaaggagtcagctctacaaagatgttgctttctttgatgcattgcaaaaagcaaagctttggactgggattcaggagacccggactctgtcattaaatcaactgtgactctgggccagttactttccatttttgagtctagatttcctacttattgagggagcttatttggatgatctttaaggtcttttttggcactaataactcggtgtctctttttttcactttcaccatttcagttgatccaccaacaaacctgagagatcaggtatggcttccaagagttgtctcggccaactctgatgaaatgcttactctgtactagacattgttacaagcatgttacgtgcataaacnatttatcttcccacatcttgtgaggaggcactatagagacgctatttgagatgggaaacaaggtacaaagagtctagttgaccttaagtacttataagaagtggagagtggagtcacatccggcttaagtccaaggttggctataacacatttggctcgttttttaccaaattttccaagagttcttgatccattcaggagttggccattggttattcgggcttatttcagcccg

SEQ ID NO: 457791 - DNA, 1727 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccagaggcggatgccccaaaccttccgtgacccagcaactgctcccctgagaaaactttctgttgacttgatcaaaacatacaagcatattaatgaggtaagacttgatttgttataataacatctatcttgcagtatgtcattgagaaaaaaagtgtgacctatttaccctaaacttttttttcattcctagtagttgtcatattgatgattattatgaagactaatgatttagaaataatattacaattatgtaaaagatatattaacaaggactgcagagtataaagataattgtggataacttgatttttttaaggttgtatttaatatactgttatttctttttttaatttttattttttgttttttatttcatttgagttctgtaataacttattcaaaacaagaaaggggaataaggactctaaaagtatatatgtgttagaatttttgctagaatttttatatatttgtttctgcttttgccatgggtgtcaggaagctctgaaatatgtttaatacctagttacaggcatttggcctagtttatttgatctatctatatttctgtgattttattgtcttttaactttttatgtgtgttcttttatctatatctttttatgataagatgtccagaagcttttttgttgtaagtaaataagataaaaaac

SEQ ID NO: 457792 - DNA, 484 bp, Homo sapiens
aagtgcagtggcacgatcataggtggtcactacagtctcagattcctgggcttaagcagtcttcccacctcagcctccccagtagctgggattacaggtaagtgccaccatactcggctcattttgatgttaattccagttttctcacctattgcacgtctcctggacttacacagaaaatagaagacagttggctgggcactgtggctcacgcctgtaatctcagtactctgggaggtcacagtgggcagatcacttgaggacaagagttcgggaccaacctgactatcacagtgaaactctgtctctactaaaaatagaaaaaattatctgggcatggtggcgcccacttgtaatcccagttactagggatgccgaggcatgagaattgcttgagcctgagaggcggaagttttagcgagctgagattgtgccactgcactccagcctgggcgacagagtgagattctgtctttaaaaaaaa

SEQ ID NO: 457793 - DNA, 5781 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457794 - DNA, 5651 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457795 - DNA, 5592 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457796 - DNA, 5306 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtc

SEQ ID NO: 457797 - DNA, 5119 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgtttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggcgttggatgcagtcagcggcgttggatgcagtcagcggcgttggatgcagtcagcggcgttggatgcagtcagcggcgttggatgcagtcagcggcgttggatcagtcagcggcgttggatgcagtagcgcgtgatcagtagcgcgtga

SEQ ID NO: 457798 - DNA, 2274 bp, Homo sapiens
cgcggcccaggtcggcctcagagagcggacaccccgagcggggggtgcgggcgccgccgccgccgcttctgctgctgctgttcctgctgctgctgttggtgccgctgccgccgccggcgagcaggcgggaccggtgtgagtgcgagtgtgtgtgcgagggagcgtgtgcgagggcgattgtgcgcgcgagtgtgcgggtgtgtgcgagtgtctgtctgtctgtgcggggactcgggggcgggcggttcgggctctcctggcggaggagccgccgccgccgcccgggccccggcgcttctcgctgcgcaggttcggagcgcgcgccattttgtgagatttacaaaatcctcctcgggaagaagccgccggcagcagccgccgctcggcgcccggcctcgccgacgccgccctctgcgccgggccggccgtgcggccccgccgcctggaatcggggcccggggactgcggtatttgccggggagggggctgtcgcctccccggccccgggcgccgctggaaccgcgagccgaggagagactgagcaggctgcggcgcggccaggagccggagcgccgggggcggagagaggctgccggggcggcgctggctgcggaggccgcggcgggagcgcggcgcgggagcccgaggctgagactcaccggaggaagcggcgcgagcgccccgccatcgtcccggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtaaatgatgtattgctttacaaattctgttttcataatttgtttttgtctttcatctgtgacagtgtaatttaaaagttgtttttaggcaaagatgtctacttaatcattcaaatgtgaggtcagtttgaatatacctatttttcatatttgtcagttgtcatgtaagtttagaattatgagataggagtaggatattttaatctactcatgaaggagaacagttagaaagtgttaagtattttggcatacattttacaggttttaaatacaatacagaaagcttaaagatgataaagaatgaaggccatcctgaagagtgatacaaacatcactctaaattttgagattatgatttggagttgaagagtaatgatcagtaggactgatggatactcagtctgaataatgtagagtaaacgagattatagacttgtagggctacagagactgtgtgcagttctgaagtctacaggttttcagtctgtgttctggaagatttttcaaggtcagaggca

SEQ ID NO: 457799 - DNA, 1592 bp, Homo sapiens
tgatacatcgttgctcattttgcagaacataacagttgcacattgcaagagtcaacttgcttcgggtcttttcatgctcatggcggtattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457800 - DNA, 1356 bp, Homo sapiens
tgatacatcgttgctcattttgcagaacataacagttgcacattgcaagagtcaacttgcttcgggtcttttcatgctcatggcggtattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457801 - DNA, 649 bp, Homo sapiens
atctccacttcctaagtgatcttggcctgttcttcccccacgctgcccaccatgcctcttttcagtgaccctggcctgagctccccctcccataatgtccttttccaacctaagcctctgcatacccctcctgcctcctcccagtgtctagcctgcccctctctccacagggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457802 - DNA, 1532 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457803 - DNA, 1296 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457804 - DNA, 2219 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgagttgagaagagtagtgctggcttcaggatttagagtagttctggtgtcagcacctcggcactaccctctggggaacctgaatgggggtctcctttccccccaggtccccagaacatctgctccctgacatccctgcatccctctcagggctgttcttcatctcccttctcttggctgtttcatcctcttgatctcttttgcctcttagatcccatctgctgttccctctttcctgctccatccactgcccttttcatgggccatctgaatgcagaacttgcagctctccttgggggtggaacagcaagggatacaggcaggctgaagcatcagcttcaccttcacgccccatctccttttcgctgtgattctttccttccacctggtcttgtctctatttcttccaaggaaggtagccacatcctgcctctgatctgcgtttcccatcatctttgcctgctcagcctcctgtcctgccctggctgcagcacagctaatagtggcttaagaggagtggcaggtccatgtgcttcccatcctggctcctccttccattcctgtgcattgccttttttctggctgtcacgcattcttggcttccatttcctcaatcacattgccctacctcccttcatgggctctcttttctccctccccacggctgttgccggtggtggctgtaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457805 - DNA, 1373 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagttcgaacctctgacatgggtggctatgctacttgccatgacttcactgaggctgtcattgctgccttgccccacccataggccctgtccatacccatgtaaggtgttcaataaagaacatgaacca

SEQ ID NO: 457806 - DNA, 1217 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457807 - DNA, 1618 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcaggtgaggcctccccacatctctactcatggggcggaggaggagggtggggagtggaatttacttcatgcctgcatctcaccctctagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457808 - DNA, 1545 bp, Homo sapiens
  misc_feature (13)..(14): n is a, c, g, or t
  misc_feature (18)..(18): n is a, c, g, or t
  misc_feature (20)..(22): n is a, c, g, or t
  misc_feature (25)..(25): n is a, c, g, or t
  misc_feature (27)..(27): n is a, c, g, or t
ccaacccaaatanncatngnnncgncnggtgtgaatcggacgagggcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457809 - DNA, 1623 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgtgaggggcatggctttgtgtaggatgggttcctgggaaggtagcccctgtactttcttggctgattctgtcccctttggcccatggacaggaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457810 - DNA, 1729 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgaggtgaggccccagaaactgggggagggcaaggatgaagatgggagagaggtggagctccttgtttcccttcccagtgtcacctagctgctgctttcttcttacccagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgtgaggggcatggctttgtgtaggatgggttcctgggaaggtagcccctgtactttcttggctgattctgtcccctttggcccatggacaggaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457811 - DNA, 1611 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggtaggtggtctgggtggggtgaatggttgagaggtgccagggcaccaggagcagagctgatggccctgcccaccctcaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457812 - DNA, 1717 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggtaggtggtctgggtggggtgaatggttgagaggtgccagggcaccaggagcagagctgatggccctgcccaccctcaggcgtaagttggacttatttgccaacgtagtccatgtgaagtcacttcctgggtatatgactcggcacaacaatctagacctggtgatcattcgagagcagacagaaggggagtacagctctctggaacatgaggtgaggccccagaaactgggggagggcaaggatgaagatgggagagaggtggagctccttgtttcccttcccagtgtcacctagctgctgctttcttcttacccagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457813 - DNA, 768 bp, Homo sapiens
atctccacttcctaagtgatcttggcctgttcttcccccacgctgcccaccatgcctcttttcagtgaccctggcctgagctccccctcccataatgtccttttccaacctaagcctctgcatacccctcctgcctcctcccagtgtctagcctgcccctctctccacagggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457814 - DNA, 921 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457815 - DNA, 744 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccctgtccatacccatgtaaggtgttcaataaagaacatgaaccaaaaaaagaaaaaaacagagaacaaaaaagaaattaaaaggaaaaaaaggaagaaaacaaaaaag

SEQ ID NO: 457816 - DNA, 1455 bp, Homo sapiens
atctccacttcctaagtgatcttggcctgttcttcccccacgctgcccaccatgcctcttttcagtgaccctggcctgagctccccctcccataatgtccttttccaacctaagcctctgcatacccctcctgcctcctcccagtgtctagcctgcccctctctccacagggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgagttgagaagagtagtgctggcttcaggatttagagtagttctggtgtcagcacctcggcactaccctctggggaacctgaatgggggtctcctttccccccaggtccccagaacatctgctccctgacatccctgcatccctctcagggctgttcttcatctcccttctcttggctgtttcatcctcttgatctcttttgcctcttagatcccatctgctgttccctctttcctgctccatccactgcccttttcatgggccatctgaatgcagaacttgcagctctccttgggggtggaacagcaagggatacaggcaggctgaagcatcagcttcaccttcacgccccatctccttttcgctgtgattctttccttccacctggtcttgtctctatttcttccaaggaaggtagccacatcctgcctctgatctgcgtttcccatcatctttgcctgctcagcctcctgtcctgccctggctgcagcacagctaatagtggcttaagaggagtggcaggtccatgtgcttcccatcctggctcctccttccattcctgtgcattgccttttttctggctgtcacgcattcttggcttccatttcctcaatcacattgccctacctcccttcatgggctctcttttctccctccccacggctgttgccggtggtggctgtaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457817 - DNA, 869 bp, Homo sapiens
ccctgggggggacaaaggatacgcagtaacatacttaccttacgccaatcccttttgcctggattcttccgtccaccggtcttgtctcaatttcctccaaggaaggtagccacatcctgcctctgatctgcatttcccatcatctttgcctgctcggtagccacatcctgcctctgatctgcgtttcccatcatctttgcctgctcagcctcctgtcctgccctggctgcagcacagctaatagtggcttaagaggagtggcaggtccatgtgcttcccatcctggctcctccttccattcctgtgcattgccttttttctggctgtcacgcattcttggcttccatttcctcaatcacattgccctacctcccttcatgggctctcttttctccctccccacggctgttgccggtggtggctgtaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457818 - DNA, 710 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457819 - DNA, 654 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcgcagcgtccatctccacattgatctcaccagccacctggcctcgcagggcgtacatcctggacctcttccacaagggtacgcacctgacgggtggtcaccagttctttcttgtactgagtcaggtgggcatcctctccctccagcaggcggaggtaggtggcaatctcctgctccagccgcgtcttcaca

SEQ ID NO: 457820 - DNA, 295 bp, Homo sapiens
cgagctcggtacccccccgactagcccgacaggtgcaataggtttctgttatattctctttcattgggccttcatataagtattggatccagtttggtgttccacattccccgactagcaccacaaccgacttcatcaagtctgtcatcggtcacctgcagactaaaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457821 - DNA, 1638 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgaggtgaggccccagaaactgggggagggcaaggatgaagatgggagagaggtggagctccttgtttcccttcccagtgtcacctagctgctgctttcttcttacccagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457822 - DNA, 1277 bp, Homo sapiens
tgatacatcgttgctcattttgcagaacataacagttgcacattgcaagagtcaacttgcttcgggtcttttcatgctcatggcggtattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457823 - DNA, 1780 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaaccacacaagacaactaacgataaccacagtcacaaacacaacaacaacgggggccatcaaatacattcccggaggggagcgatatatcacacacaccgactattgaaacagggctccataagacaagcacctgaaacaaacgccaggccgataacaaccggcagggacaacgcactcggacttagtaaaccacctactggtggaaataggacaccacagagtcaacacggcataaatcagtcaacgtcaca

SEQ ID NO: 457824 - DNA, 1413 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457825 - DNA, 1494 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457826 - DNA, 1101 bp, Homo sapiens
  misc_feature (1060)..(1060): n is a, c, g, or t
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactcccagcatgatcgcaantcggtgaaaggaggtgatcgtttggcggtgcggactcggtg

SEQ ID NO: 457827 - DNA, 1522 bp, Homo sapiens
ttatttcagtactgctggctgggcttcgttgtagatacgtatgtgcttggctcgctcgcttttacacctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457828 - DNA, 1709 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgtgaggggcatggctttgtgtaggatgggttcctgggaaggtagcccctgtactttcttggctgattctgtcccctttggcccatggacaggaaacttggggatgggttgttcctgcagtgctgtgaggaagttgctgaactgtaccccaaaatcaaatttgagacaatgatcatagacaactgctgcatgcaggtgaggcctccccacatctctactcatggggcggaggaggagggtggggagtggaatttacttcatgcctgcatctcaccctctagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457829 - DNA, 1585 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgtgaggggcatggctttgtgtaggatgggttcctgggaaggtagcccctgtactttcttggctgattctgtcccctttggcccatggacaggaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaacca

SEQ ID NO: 457830 - DNA, 947 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgtgaggggcatggctttgtgtaggatgggttcctgggaaggtagcccctgtactttcttggctgattctgtcccctttggcccatggacaggaaacttggggatgggttgttcctgcagtgctgtgaggaagttgctgaactgtaccccaaaatcaaatttgagacaatgatcatagacaactgctgcatgcagctggtgcagaatccttaccagttttatgtgcttgtatacccagaaccggggataagatcctctaagtca

SEQ ID NO: 457831 - DNA, 680 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccctgtccatacccatgtaaggtgttcaataaagaacatgaacca

SEQ ID NO: 457832 - DNA, 692 bp, Homo sapiens
gcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaagcgggcgtaaacttcgtcccagaacctatagaatcaggtgatgttccgacgatcgt

SEQ ID NO: 457833 - DNA, 957 bp, Homo sapiens
  misc_feature (848)..(848): n is a, c, g, or t
  misc_feature (857)..(857): n is a, c, g, or t
  misc_feature (859)..(859): n is a, c, g, or t
  misc_feature (865)..(865): n is a, c, g, or t
  misc_feature (876)..(876): n is a, c, g, or t
tgatacatcgttgctcattttgcagaacataacagttgcacattgcaagagtcaacttgcttcgggtcttttcatgctcatggcggtattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagngcaatcttncnatggtngctgtgagccnctctttggaatttgcaaccgctgtggcgtggggacgggggcccccgaaaataaacctttaaggcggccctcgcgggggaac

SEQ ID NO: 457834 - DNA, 681 bp, Homo sapiens
tgatacatcgttgctcattttgcagaacataacagttgcacattgcaagagtcaacttgcttcgggtcttttcatgctcatggcggtattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgccaggggcgtggtttgacgtctcatcatttgacaaccaaacccggttctgccctactgcaaagtatt

SEQ ID NO: 457835 - DNA, 1536 bp, Homo sapiens
  misc_feature (1124)..(1124): n is a, c, g, or t
  misc_feature (1220)..(1222): n is a, c, g, or t
  misc_feature (1357)..(1357): n is a, c, g, or t
  misc_feature (1398)..(1398): n is a, c, g, or t
cgcccgggcaggtttcaaatccaggcccctgactctaagctgaaccatgagaatctgctgcctcccaactaactaattatctacatgggttctacgcagtatgatcctttgggccctcaggaactctcacattcttttggcctgattcctgcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagccgtgaaatgcctgttctttgaccagtggcatctcctctcaggaagcactgatggcctggtcatggcctggagcatggtggggaagtacgagcgctgcctgatggccttcaagcatcccaaagaggtgcctgacgtgtcccttctcttcctccggatcatcagcgcctgtgcaaatggcaagatccgaatttacaatttcctccatgggaactgtatgaaggtgataaaagccaatggcagaggcgatcctgtgctgtcctttccacagaatttcagtctgccacatcagcacatttgctaaaagaattaacgtgggatggaatggaatcgaaccaagtgctacagctcagggaggaaatgcctccttgaccgagtgtgctcatgtgagactccacatcgcgggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatggcaactcctggaacagcacaacaagtggcaaaggacacagctagcaacgggctggaaaaaggcagagaactcaactcaatcanactacctaaaatcggcactgacaaagtacaaataatccacctatccagtagaggcagcactgatctggctgaattcctggatatggggaatcctcnnnatgaaacaaacttacaataagaaagaatatgtttgtgggagctctggctgctcttcttgattttgctagctaagagtaaagtggttaagagagtcaggattagagtgttctggattcatataggttctgtccctncctggctatagggcagctaggtttcacttactcctctctanaagagaaatgatcatcttttcctcctagggttgaagactgactgagacaatgcccctgcacagtgttccattttatatttagtcatgaacaaacaacttcagacacaatattggaagatttgggcagaaaatactacc

SEQ ID NO: 457836 - DNA, 765 bp, Homo sapiens
cgcccgggcaggtttcaaatccaggcccctgactctaagctgaaccatgagaatctgctgcctcccaactaactaattatctacatgggttctacgcagtatgatcctttgggccctcaggaactctcacattcttttggcctgattcctgcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagccgtgaaatgcctgttctttgaccagtggcatctcctctcaggaagcactgatggcctggtcatggcctggagcatggtggggaagtacgagcgctgcctgatggccttcaagcatcccaagtaggtgcctgtgaagcccggagcgatgaacctggtgtccttcccttccccgtcatagcctagactgcaatcattggcagaccttctgctccctgtagacatcgtgttctctgcacctcaccctctctgcttccctcctcttccacctgggacccatttttccccaccatcttctctgtctgactgttagcctcttc

SEQ ID NO: 457837 - DNA, 1575 bp, Homo sapiens
  misc_feature (1163)..(1163): n is a, c, g, or t
  misc_feature (1259)..(1261): n is a, c, g, or t
  misc_feature (1396)..(1396): n is a, c, g, or t
  misc_feature (1437)..(1437): n is a, c, g, or t
cgcccgggcaggtttcaaatccaggcccctgactctaagctgaaccatgagaatctgctgcctcccaactaactaattatctacatgggttctacgcagtatgatcctttgggccctcaggaactctcacattcttttggcctgattcctgcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagccgtgaaatgcctgttctttgaccagtggcatctcctctcaggaagcactgatggcctggtcatggcctggagcatggtggggaagtacgagcgctgcctgatggccttcaagcatcccaaagaggtgcctgacgtgtcccttctcttcctccggatcatcagcgcctgtgcaaatggcaagatccgaatttacaatttcctccatgggaactgtatgaaggtgataaaagccaatggcagaggcgatcctgtgctgtccttctttattcagggcaacagtccacagaatttcagtctgccacatcagcacatttgctaaaagaattaacgtgggatggaatggaatcgaaccaagtgctacagctcagggaggaaatgcctccttgaccgagtgtgctcatgtgagactccacatcgcgggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatggcaactcctggaacagcacaacaagtggcaaaggacacagctagcaacgggctggaaaaaggcagagaacgtgggagtgatcatctccaactcaactcaatcanactacctaaaatcggcactgacaaagtacaaataatccacctatccagtagaggcagcactgatctggctgaattcctggatatggggaatcctcnnnatgaaacaaacttacaataagaaagaatatgtttgtgggagctctggctgctcttcttgattttgctagctaagagtaaagtggttaagagagtcaggattagagtgttctggattcatataggttctgtccctncctggctatagggcagctaggtttcacttactcctctctanaagagaaatgatcatcttttcctcctagggttgaagactgactgagacaatgcccctgcacagtgttccattttatatttagtcatgaacaaacaacttcagacacaatattggaagatttgggcagaaaatactacc

SEQ ID NO: 457838 - DNA, 590 bp, Homo sapiens
ttctggattgcgggctccctcaaccacctgtattcagggcgctctgtgctgtgggcacatgagctgttggtgagcctgctcttcggaggtgctaggccacgggaagtccttctagaatctgacttgatgggctcgatgagtctttgcttctgtgatggggagcagaactccactgtaacctttccttttccccctttttccccactcccatgtcttcctctgtctccctccttttcagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaaggtaagtgggcagtgggctaccttggcggaaagggcactggggaggagatgggtgggctccccctacctagctcctcaggtcatcctagagtaactgagtatggccttcaagaaggacagtcctgaagctctaaaggggaaggccccaaagtgaggcattcagagtccgtggagggtaggggctccaccgcccacatcatgacc

SEQ ID NO: 457839 - DNA, 1133 bp, Homo sapiens
taagatcctctttctctctcccccgcccctgccatcctgactccctaaggttttctatagtactatgctctcactcccaacttgaacacttctttaagctttccatccgtagtccttaattgggtttcagtccctccactcccattgttttttctccttacccctctttctcttttgccccctcccccaattctgtctccattcctagggttctaccaatcacatccgtgcactgtgatttagaggcatattctctgtagctgagaggggagccctgcgctcactgccatatgtttattagttatgaactgaataaaggaaggcttgacttcctgggtcatgggagtgaaggagtctgggtgacaggaagcaagcggcctgtcatgcctattgcctagctgccagattaaccttgccttgaaaataacgattgccccataggctattcagtgtaaggaagacaaaaattccttgggaacctactagtgggtttgccttccagatttggtagacgcaaaaagcaaagggggaacatgggcaaaggaagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaaagtcaccaagggaattgcattgaaaattttccattttttaaatgaatggcctgggcctttttaggccttttaattggaccttaaaaaggattgcccttggcctaaatatggttattgggctggatc

SEQ ID NO: 457840 - DNA, 982 bp, Homo sapiens
gattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgcta

SEQ ID NO: 457841 - DNA, 1496 bp, Homo sapiens
gattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttttgggtagcaaacttggacattaaaaggtatctggtaagtaagcaaactcatacaactaatgtcctttcttaggctaatgatataagagtgaagagcaggacttggtcaatggattgccattttatggtagacctctagagaaactgtctagttaaatggggctagctagactaggaattttattctattactccaggggacccagcagtgctcattctcgtgtgtgtgtgtgtgtgtgtgtgtgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttc

SEQ ID NO: 457842 - DNA, 1544 bp, Homo sapiens
cagaatcttgctgtgtcgcccaggctggactgcagtggtgtaatcttggctcactgcaacctctgcctcccgggttcaagcgattcttgtgcgtcagccttcttgagtacctgggactacaggctcccagggtgatttgagagttgccaggagaggaaggccatttggcaagaatcctgacagacaaaagctggaggagggtagagcaagatggcagaatagaaagcgccaccgatcatactccgcccccacaaggacaccaagttaactacctacacagaagaaataccttcataagaatcaaaaatcagacacaccctgggccagaagagaacccacttccttgaaggaaaggatccagtcctggcagcattcatcgcctgctaactgaagatcccttgggccttgaataccaacagcaatacccagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttttgggtagcaaacttggacattaatgatataagagtgaagagcaggacttggtcaatggattgccattttatggtagacctctagagaaactgtctagttaaatggggctagctagactaggaattttattctattactccaggggacccagcagtgctcattctcgtgtgtgtgtgtgtgtgtgtgtgtgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttc

SEQ ID NO: 457843 - DNA, 1662 bp, Homo sapiens
taagatcctctttctctctcccccgcccctgccatcctgactccctaaggttttctatagtactatgctctcactcccaacttgaacacttctttaagctttccatccgtagtccttaattgggtttcagtccctccactcccattgttttttctccttacccctctttctcttttgccccctcccccaattctgtctccattcctagggttctaccaatcacatccgtgcactgtgatttagaggcatattctctgtagctgagaggggagccctgcgctcactgccatatgtttattagttatgaactgaataaaggaaggcttgacttcctgggtcatgggagtgaaggagtctgggtgacaggaagcaagcggcctgtcatgcctattgcctagctgccagattaaccttgccttgaaaataacgattgccccataggctattcagtgtaaggaagacaaaaattccttgggaacctactagtgggtttgccttccagatttggtagacgcaaaaagcaaagggggaacatgggcaaaggaagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttttgggtagcaaacttggacattaatgatataagagtgaagagcaggacttggtcaatggattgccattttatggtagacctctagagaaactgtctagttaaatggggctagctagactaggaattttattctattactccaggggacccagcagtgctcattctcgtgtgtgtgtgtgtgtgtgtgtgtgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttc

SEQ ID NO: 457844 - DNA, 854 bp, Homo sapiens
gagaagacacaagaggggttccaagtggcttaactagtaacatgatcattatttgacacccttcccttgatggggaggccccaaggcattttgataaatagttttcttagctgtgttctttcaggctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttttgggtagcaaacttggacattaatgatataagagtgaagagcaggacttggtcaatggattgccattttatggtagacctctagagaaactgtctagttaaatggggctagctagactaggaattttattctattactccaggggacccagcagtgctcattctcgtgtgtgtgtgtgtgtgtgtgtgtgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttc

SEQ ID NO: 457845 - DNA, 398 bp, Homo sapiens
gattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaagtaaggacatgctgtggcctccatcggctgctcacaaaggcggtggggtgggggtggggaagagggcgaga

SEQ ID NO: 457846 - DNA, 1084 bp, Homo sapiens
cagaatcttgctgtgtcgcccaggctggactgcagtggtgtaatcttggctcactgcaacctctgcctcccgggttcaagcgattcttgtgcgtcagccttcttgagtacctgggactacaggctcccagggtgatttgagagttgccaggagaggaaggccatttggcaagaatcctgacagacaaaagctggaggagggtagagcaagatggcagaatagaaagcgccaccgatcatactccgcccccacaaggacaccaagttaactacctacacagaagaaataccttcataagaatcaaaaatcagacacaccctgggccagaagagaacccacttccttgaaggaaaggatccagtcctggcagcattcatcgcctgctaactgaagatcccttgggccttgaataccaacagcaatacccagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgcta

SEQ ID NO: 457847 - DNA, 1442 bp, Homo sapiens
gattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttttgggtagcaaacttggacattaatgatataagagtgaagagcaggacttggtcaatggattgccattttatggtagacctctagagaaactgtctagttaaatggggctagctagactaggaattttattctattactccaggggacccagcagtgctcattctcgtgtgtgtgtgtgtgtgtgtgtgtgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttc

SEQ ID NO: 457848 - DNA, 952 bp, Homo sapiens
  misc_feature (898)..(898): n is a, c, g, or t
  misc_feature (904)..(904): n is a, c, g, or t
  misc_feature (934)..(934): n is a, c, g, or t
gattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatggcggancgggtnggtcgggtgtgcagctgaaaaagcgcgggntgggaaatacccaggggg

SEQ ID NO: 457849 - DNA, 1308 bp, Homo sapiens
gattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttttgggtagcaaacttggacattaatgatataagagtgaagagcaggacttggtcaatggattgccattttatggtagacctctagagaaactgtctagttaaatggggctagctagactaggaattttattctattactccaggggacccagcagtgctcattctcgtgtgtgtgtgtgtgtgtgtgtgtgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttc

SEQ ID NO: 457850 - DNA, 926 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccaggaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacaggtaagagaatacgtatctgtgg

SEQ ID NO: 457851 - DNA, 850 bp, Homo sapiens
gtctgtaaacatgtttaatgctgcttcttccatgaggtgggatgtgggtatttttaggacttttatcatcacataatcctttttatggatgtgattcttcagacttgtcagtttttcataacaatggaaacaaagctattaccatttcttacgaaataccgattttcatagtggcatgatgagacattttatacaagtacctcatgaaaggacatctaggtagttcccagttagaataaaaactgcagtgagcagctttacagctgaatttctcgccatttctgacttgtttccaagatacagaattacttcatcaaaaggcacattaacacatttttattgtagtgttaataaataccattaaaatgtattaaaatatgtacatatggttttatgttaattgaaaacatctttaaacattaggaacgtagtgagctctggttggtggtaggtttttgtggtgctgccagccctctgggttctcagtccccgctgccagattcgacccacgctctggactccatcctgtcctgccccgggctctcttttttcctgttgctggttatgagtgaaagtcccggagggagggatctaatggttttacagtttgttccctctggggcactgctcctgatggaatgatgagtgagggagaggcagcgtgtggctctgctcagcctcctgtttctgtcgttatgggttccaggagacagggccagaagagaaccagacagagatggagtaagtgccagagcgttggcgtgctgtagtgcagacactcagcctccccgttctgtttgtgtgactgacaaaacccacacctgtggggcacagcctgtcatttgaccac

SEQ ID NO: 457852 - DNA, 906 bp, Homo sapiens
gtctgtaaacatgtttaatgctgcttcttccatgaggtgggatgtgggtatttttaggacttttatcatcacataatcctttttatggatgtgattcttcagacttgtcagtttttcataacaatggaaacaaagctattaccatttcttacgaaataccgattttcatagtggcatgatgagacattttatacaagtacctcatgaaaggacatctaggtagttcccagttagaataaaaactgcagtgagcagctttacagctgaatttctcgccatttctgacttgtttccaagatacagaattacttcatcaaaaggcacattaacacatttttattgtagtgttaataaataccattaaaatgtattaaaatatgtacatatggttttatgttaattgaaaacatctttaaacattaggaacgtagtgagctctggttggtggtaggtttttgtggtgctgccagccctctgggttctcagtccccgctgccagattcgacccacgctctggactccatcctgtcctgccccgggctctcttttttcctgttgctggttatgagtgaaagtcccggagggagggatctaatggttttacagtttgttccctctggggcactgctcctgatggaatgatgagtgagggagaggcagcgtgtggctctgctcagcctcctgtttctgtcgttatgggttccaggagacagggccagaagagaaccagacagagatggagtaagtgccagagcgttggcgtgcgtcggcaaatcacttcccgccggtggggctgcaacccaccgggggcgcgtattagcaccctggggggggggcccgcaaaaggaaaccccccctcaagcaagttgccccacgctcaacccagagccccgcagcccagggccc

SEQ ID NO: 457853 - DNA, 2760 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcgcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457854 - DNA, 3083 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaacaaaaaaaagaacacacacaacaaaagggggggggccaaaaagatccccagggaccagttacgtgcacaggtttttgcacagggccctaaaggagcgaaaaggagagaggcggttacacgtcggctggcaaacgcactggcccgggagactcctcctgctggactatggcccccacaaaagcacggataattcacgtaggtacagcatgcgatcgtcgtctgatagcgcgccaggaaacggcagcagggacgcaacacaggacgaccagcaaa

SEQ ID NO: 457855 - DNA, 2836 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaataaataaaaaaataaaagaaaaggg

SEQ ID NO: 457856 - DNA, 2907 bp, Homo sapiens
gtgtgtcggtggccggctggccctgctgctccgcatgccggttacactgcaccaggttcttgaaggcaattagctgtagaattaagttcttagaaattctcactgtctctgtcttattctatcaagtctcctctgtcttaccacctctcagttctgacgttcttgagccgagttggtgggcagaccacgccacttgatctccttcttctccttggctgattaattcttggccattagcgcgttgtacggcttcgtagacccgctgtcttatgtttgtctggtcttaagcctgttcgttgggaagatgtggttgtcggcagcactgaactccgcaaccagctcgtctgccacttcgttgtaggaagtggtccctttcctctgcaccttctcgcagaccttcatggagaaatgccgtaggcccttgccattcttctctcctttcctgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457857 - DNA, 2688 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457858 - DNA, 2448 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttatgctgtaatagtttatgctgtaatagtttatgctgtaatagtttatgctgtaatagtatatgctgaatagttatgctgtatcgtttatactgtatatcctttca

SEQ ID NO: 457859 - DNA, 2731 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457860 - DNA, 2599 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457861 - DNA, 2161 bp, Homo sapiens
tctgcgttccactttccagggtgggcaaagtccacggcacggcaccccctccaaggccatcaccctgtaggtgccatggtggtaggtggtcttagaggggtgaaggacagcaaggaatcgacttccaaaattggtgttttgttgagcgccgttgccgtggaggacacttttatcagggcacggatggctgtgcgcccgctttcccttagttctcccctcaggatcccgtttcctgagcgcttttctccctgggctgcagaggtcagcacccagcggccggcgctggcatttcagatgtccaggccaactcctcgctgtcacgtggacgcagggagggctgtgaggacccctcgagcacaggggctgcgttcttgtgccgccacgggccacctggctcctcttattttttttagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457862 - DNA, 1521 bp, Homo sapiens
agcttttgttgaaggagctttttttctgttctggtgaattctttccttgggggccgtagggtcccagccactgacagcaggatggctttaagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457863 - DNA, 2216 bp, Homo sapiens
gtctgtaaacatgtttaatgctgcttcttccatgaggtgggatgtgggtatttttaggacttttatcatcacataatcctttttatggatgtgattcttcagacttgtcagtttttcataacaatggaaacaaagctattaccatttcttacgaaataccgattttcatagtggcatgatgagacattttatacaagtacctcatgaaaggacatctaggtagttcccagttagaataaaaactgcagtgagcagctttacagctgaatttctcgccatttctgacttgtttccaagatacagaattacttcatcaaaaggcacattaacacatttttattgtagtgttaataaataccattaaaatgtattaaaatatgtacatatggttttatgttaattgaaaacatctttaaacattaggaacgtagtgagctctggttggtggtaggtttttgtggtgctgccagccctctgggttctcagtccccgctgccagattcgacccacgctctggactccatcctgtcctgccccgggctctcttttttcctgttgctggttatgagtgaaagtcccggagggagggatctaatggttttacagtttgttccctctggggcactgctcctgatggaatgatgagtgagggagaggcagcgtgtggctctgctcagcctcctgtttctgtcgttatgggttccaggagacagggccagaagagaaccagacagagatggagtaagtgccagagcgttggcgtgctgtagtgcagacactcagcctccccgttctgtttgtgtgactgacggggaggctgggtgggccgcctgcactgacggcgccatccgcctcctgccttgcagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457864 - DNA, 1705 bp, Homo sapiens
acctgtcagagttaccggtcagccgggcgggcgccgccggggtctggggtggacgccgcgagcctgcacgttgcgccgggaccccggggctgtgcccaggtgggtggtggggcacccccctgcagcggcgggagggaggcgctgcgccctggctcctggggctcggccccaccctcggccgctgggcgggccgtcggggacctgggggtagtggtggtgaccctgcgggcccgcgggccacttttccgcagggggcatttccgtctggcgaggcgactgaaaatcctgagtgtgggagtcggtttggccagctccgctctcaggatggagggtgcctttgggaaggaagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457865 - DNA, 2449 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagaggtgacagtcgttgagggtgtgggagaggcgtcatctgggcctcccccggggtccaggggccaaggcagggcagccgtctcaggtgtggccatcaggtctgtggctgctctgacgtggcttgtctgtccaggcagtggggccccgctggctttccctgtgtggagagctgcttttcttagttggtttctgctcactaaaaactgaaagtaatacatggtggtttttttttcatagtatcacctaataagtaaagtaggaatgaaaaccacccaaatcctcctgtccccggcagcccaagtaacagcaagtatttccaggttttttttcccatttttcagaacgcgtctgcggtcacagcgcacgtatttttcagaacgcgtctgcggtctgggcgcaagtagttttcagaacgtgtctgcgatcacagcacacatttttcagaacgcatctgcggtcatggtgcatgtgtttttcagaatgcatctatggtcatagcgcatgtatttttcagaacgtctgccatcacggcgcacgtgtttttcagaacgcgtctgcggtctcggcgcacgtgctgcgatcacagtgcatgtatttttgcgaacgcgtctgtgattatggtacacgtatttttcagaacgcgtctgcaatcacagcgcacgtatttttcagaacgcgtctgtggtcacagcacacatattttgttccgtgcatttttcagcttacattttattgtatgaatatatattgtttctatgctattaaagggcctttatttaaataaatttgtatttaatctttgacctgcaatcccacagagtagaatggtgtccctaggtattgatcttagtgcttcaaagataaatataacttttatggtaaatattaacaaaacaatgattttattaacttttatattgcattgtgatacaatatatagtattactttatattaatcttaagtgttaataaaatctttaattagaaaaa

SEQ ID NO: 457866 - DNA, 602 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatacttttaaagcgtctgaagcgggatgaaggtgaaagatggaaggatctgatctctgaagctgcggtcaccacccacaagttgtggccttggataccacactgcagttgggtggtgatggggtggtgccttctgactttttccttatctttaccgactgtgttaattgataattttaaataaacgccttaattaaattgaggtggagggtgttgca

SEQ ID NO: 457867 - DNA, 2810 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457868 - DNA, 2598 bp, Homo sapiens
acctgtcagagttaccggtcagccgggcgggcgccgccggggtctggggtggacgccgcgagcctgcacgttgcgccgggaccccggggctgtgcccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457869 - DNA, 2528 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaac

SEQ ID NO: 457870 - DNA, 2971 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggtgagcacttccctctggacccttagagttgtaggactgcttgcggttcgcacctccacgttctcctgggccacgtgtgtcacacagtcgtgcgatggggctcccacgcgcgttgacgccagcctccgaatcacactcacccatcatcgtggcctgcacaggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457871 - DNA, 2471 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagcactatttgactttttaactttcgtgggcacacaaatggaggacc

SEQ ID NO: 457872 - DNA, 2432 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttaggaaggtaggtgccgtaggttaagcttatggcatcgtggtgggtatgggactgttggaggttgaagggtatggtagggaagtggggtattacagggggtgtgacattgtatatggggatagatgtactttaacgttgggtgtgttagcactcagtttgaggatgatgtgcc

SEQ ID NO: 457873 - DNA, 2243 bp, Homo sapiens
  misc_feature (2236)..(2236): n is a, c, g, or t
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcgactggtagcatgaagnttgtcgg

SEQ ID NO: 457874 - DNA, 1667 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaa

SEQ ID NO: 457875 - DNA, 1037 bp, Homo sapiens
gcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacaactgttttaataaaagatttacattccaaaaaa

SEQ ID NO: 457876 - DNA, 958 bp, Homo sapiens
gtgtgtcggtggccggctggccctgctgctccgcatgccggttacactgcaccaggttcttgaaggcaattagctgtagaattaagttcttagaaattctcactgtctctgtcttattctatcaagtctcctctgtcttaccacctctcagttctgacgttcttgagccgagttggtgggcagaccacgccacttgatctccttcttctccttggctgattaattcttggccattagcgcgttgtacggcttcgtagacccgctgtcttatgtttgtctggtcttaagcctgttcgttgggaagatgtggttgtcggcagcactgaactccgcaaccagctcgtctgccacttcgttgtaggaagtggtccctttcctctgcaccttctcgcagaccttcatggagaaatgccgtaggcccttgccattcttctctcctttcctgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaagcctcccgcaggagcggacagccgggatctcggtgtgaggtcgggatcggatgagccgtgtggttggggatgttcccaggtgtgcctggatttgggctccagttgcagcatggggcctttccctcatcagggagcccgtggccagtgctagattttccatagccctctgcagctgcccacgtgttgttgtgggagaggtgatggcgcccacagcactcctgtgtgccccagcccatgccatccttccagtaactggagggtggtgggtggggccgcggccccaaccagaggcagct

SEQ ID NO: 457877 - DNA, 1698 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457878 - DNA, 1754 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457879 - DNA, 1644 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457880 - DNA, 1934 bp, Homo sapiens
  misc_feature (1720)..(1720): n is a, c, g, or t
  misc_feature (1725)..(1725): n is a, c, g, or t
  misc_feature (1772)..(1772): n is a, c, g, or t
  misc_feature (1777)..(1777): n is a, c, g, or t
  misc_feature (1798)..(1798): n is a, c, g, or t
  misc_feature (1807)..(1807): n is a, c, g, or t
  misc_feature (1819)..(1819): n is a, c, g, or t
  misc_feature (1824)..(1825): n is a, c, g, or t
  misc_feature (1829)..(1829): n is a, c, g, or t
  misc_feature (1832)..(1832): n is a, c, g, or t
  misc_feature (1836)..(1836): n is a, c, g, or t
  misc_feature (1852)..(1852): n is a, c, g, or t
  misc_feature (1859)..(1859): n is a, c, g, or t
  misc_feature (1865)..(1865): n is a, c, g, or t
  misc_feature (1870)..(1870): n is a, c, g, or t
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaacaaaaaaaaaaaaaaaaaanaaaanaaaaaaaaaaaaaaaaaaaaaaaaaaaaaaaaaaaaaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 457881 - DNA, 1644 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457882 - DNA, 1700 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457883 - DNA, 1701 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttgattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457884 - DNA, 839 bp, Homo sapiens
  misc_feature (755)..(755): n is a, c, g, or t
  misc_feature (775)..(775): n is a, c, g, or t
  misc_feature (781)..(781): n is a, c, g, or t
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaggggccntttccttttgccgttaaatnaggccngacacaaagggatccctcaaggggggaaagcttcccccaccacccttttgggacggga

SEQ ID NO: 457885 - DNA, 843 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagggccctcctttttggccggtaaataaaggcctgacacaatggggatcctccaagattggaaagactcctcacccacccacctttgttgaacgga

SEQ ID NO: 457886 - DNA, 833 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaatccttttgccacttaataggcgccaccacaaggggcctgtcaggggggaagattttcctcaacccaccatgttgaaggggcctga

SEQ ID NO: 457887 - DNA, 1700 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457888 - DNA, 1678 bp, Homo sapiens
ccccgggctgtacgaattcggctcgagctcctctgttcagcttttaacaatctattttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457889 - DNA, 1828 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacggttagagctttctccttttctttcaactactcctggcagttgtggggtcatggaatttttgtaaaaaatggggtggaggaaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457890 - DNA, 2117 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 457891 - DNA, 1957 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacggttagagctttctccttttctttcaactactcctggcagttgtggggtcatggaatttttgtaaaaaatggggtggaggaaaataaggcatctgctgagtgtataaccattttacctcttgtttttagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaatccatggaaactcaccggggaagagtcattttctatcggctttggacttctgctatgaaatggcaattcctttgagccagtctgtctaaagtcggcagcaaaggagaagcagatgaagggagtagaaaagagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457892 - DNA, 2356 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaatccatggaaactcaccggggaagagtcattttctatcggctttggacttctgctatgaaatggcaattcctttgagccagtctgtctaaagtcggcagcaaaggagaagcagatgaagggagtagaaaagagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataaaaatgatcctttgcctaggaaattccttccttcttcgagggaagacactccagatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 457893 - DNA, 2171 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacagtagcctggggaggagattcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataaaaatgatcctttgcctaggaaattccttccttcttcgagggaagacactccagatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 457894 - DNA, 1227 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggaagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 457895 - DNA, 778 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctagttccaaaccagaccaagctgactgactttgaagggaacatcctgggtaggcccttcccgaaaaaaaccccccagaaccttttggttgtaacaaacccgccgggtatatggtggttttggggggaccccacagaaggccccctttaaatgcaattgggaaagggccccctctcttttggggaggccttttcaaacaacaggggccccttttttttttccccccgaggttaaagggggcccggccccccccccctcagggaaaatttccccaaacgcccccaaaaaaaaccctttggaaaaaaaaaggcctacttttaccccccaaaaaaaaaactttttaaaaaatgtcccccccccttattgggggagaaaaaaaaaagggggcctcccccctccgggggggaaaaccc

SEQ ID NO: 457896 - DNA, 721 bp, Homo sapiens
agaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcaaaagtcaactaaactccaacttcaaattcacgatatccagctactccttggctccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaaca

SEQ ID NO: 457897 - DNA, 1869 bp, Homo sapiens
  misc_feature (1707)..(1707): n is a, c, g, or t
  misc_feature (1712)..(1712): n is a, c, g, or t
  misc_feature (1733)..(1733): n is a, c, g, or t
  misc_feature (1742)..(1742): n is a, c, g, or t
  misc_feature (1754)..(1754): n is a, c, g, or t
  misc_feature (1759)..(1760): n is a, c, g, or t
  misc_feature (1764)..(1764): n is a, c, g, or t
  misc_feature (1767)..(1767): n is a, c, g, or t
  misc_feature (1771)..(1771): n is a, c, g, or t
  misc_feature (1787)..(1787): n is a, c, g, or t
  misc_feature (1794)..(1794): n is a, c, g, or t
  misc_feature (1800)..(1800): n is a, c, g, or t
  misc_feature (1805)..(1805): n is a, c, g, or t
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaaaaaaaaaanaacanaccaaaaaaaaaaaaactcgnggggggccngtacccatttgncctanngggngcngttnacattaattggccggngtttaanacgggngactnggaaaaccttggcttgacccaacttaaatggctttgagcctttaccaacagttgggcaacctta

SEQ ID NO: 457898 - DNA, 1642 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctaatagagctccatttcccctcttaaatgagaaagcatttcttttctctttaatctcctattccttcacacagttcaacataaagagcaataaatgttttaatgcttaa

SEQ ID NO: 457899 - DNA, 1645 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgaatctcctattccttcacacagttcaacataaagagcaataaatgttttaatgcttaa

SEQ ID NO: 457900 - DNA, 1694 bp, Homo sapiens
cgaattcggccattatggccgggggaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457901 - DNA, 828 bp, Homo sapiens
  misc_feature (780)..(780): n is a, c, g, or t
  misc_feature (806)..(806): n is a, c, g, or t
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaccattcctttctgcgttaatgaggcctgacancatggatctggcaggttggaagtctntcagcaccagcatgtgcacgga

SEQ ID NO: 457902 - DNA, 867 bp, Homo sapiens
  misc_feature (829)..(829): n is a, c, g, or t
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaaatggtgataccttgtacacttgtgcgttaagacccacatatatctatggggaagggggccccccctcttcccgctaaanccttttggggaggggcgggccccaacttgcttagggtg

SEQ ID NO: 457903 - DNA, 839 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaagggggcccatttctttctgtcagtttaatgagggcctgacaacatggggacctggacagggtgggaaggtctctcatgaacccaccccta

SEQ ID NO: 457904 - DNA, 1777 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacggttagagctttctccttttctttcaactactcctggcagttgtggggtcatggaatttttgtaaaaaatggggtggaggccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaagaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457905 - DNA, 1700 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctgctgtgctggcggctaatgggtggaatctaaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457906 - DNA, 2171 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctggtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataaaaatgatcctttgcctaggaaattccttccttcttcgagggaagacactccagatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 457907 - DNA, 2225 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacagtagcctggggaggagataaaacaagttggttaaatgaggatcagaaagaaggacaagaaagggaagagaagtcactccattgaacacctgctgagctcttggccaagtgcctttgctgatcactactgactggggagttcaaggctggtaacctcagttttttagatgagaaaactagggctgagagacagcaagtaacttgtccaaggccccaaaagtaagtaagtaagtaggagagttagactttaaactcactcctgtgtgactccaaaggctgtggaagctctttctactgtggccccaatcccccgggccagaatcagaccttccaggtgccaccatagtcatcattttgaaccttgtgtgtaggctgatgagaacattcagagtctttctgcccacctcaaagaagtcctctcaagagaactagcaaagctggttcacagaggtctgtcaggacagaattatccagcacatgccttcccataatattttcttaacaaaaagagtttcccagtgtccagaatacaatctcttcagctcaccacagggtctactattacagagccatttcctgccaggtgcccaaagtgcaccctcatttgatccacattttttaaaggaatcttgccatgcagtctcaccctctgattcccagagcccagtctcttcaaaacacagctccccactgctggcctgaccctccacattcagactacccaaactccttttataaagcaactaattgcttttgagtctccagcactgtctaaaaaaacaaacaaaaaaaaaacctttccagtttctacatagccatacccctaagtaccgctatagttcaaggagtgtgctaagagtgaatagttttttgttttaattttgactttccacagctcccaaaaacaagggataagaaatgacaaggggagtgttagaggcgtctgtttcttaaaaccattatcactcccgggcttagaaaatacttcacaatgatggccatttcatgaggctgtctctccagaaactcaaattgcacagagactttaaaagtggctaagaatacaaaataagtaaataaaaatgatcctttgcctaggaaattccttccttcttcgagggaagacactccagatacctccatgagctttgcttccacacagctcaggtgatgctgacaggtcttcccagcgcaggtgttatcagcagagggcacactccctccccagtcctccaccaggctccacaggaaatgccagggcaggatttaaaggaaggtttatcacccccactttatataactgggtaacagagtcatagccagaattggaagcagcttttccagggaacacacaatcaggaaaggagtgtgggtttccagcatctccccacaacccactgtttgctcgatgactccagggatggtctttgtgacaaagttttattaatccattgcaaaatgagaaaaataccagcaattctatgtatatctaagagtgtatattgcctatattcaactgtgaatttgtgtgtgtaacacaaattcttccactgccctttcttgcctaaggactgattgggactgttcatattctcagagtatagcctcctgattttttagattttaaatgatctgtctttaattgtattgatgacaaatcatactttttcaatatccttacttggcaa

SEQ ID NO: 457908 - DNA, 658 bp, Homo sapiens
cacttatctgatacgataatcaaaatgtcatatctaatctctactcatctcacgatttggtacatatcaatataatcattatatcaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaggcttcatacagaaggcaacaggggcacaagcccaggtcctgctgcctctctttcacacaatgcccaacttactgtcttcttcatgtcatcgaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaa

SEQ ID NO: 457909 - DNA, 4382 bp, Homo sapiens
ctcgtaccaagcgtgtcgtagtggggctgttggggccccacagaaagtcagcggaacgtgaaatgggaaaggaatcatgcgactctgtaataagaagctgacagaaccatgaaggatcagggactgaaagcattagataagttgttagtgggatgcaggttccacaggcaagcggaacgattcaagcgaattagtaaagtttctgcccggatcttgaaagccgcttccgttgctcagcggaagtgtcggtcgcaagaggacagacgcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccatttaaaatacaaaatcctattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgttcatactgctactttcccatgtttcctatatgcctcccctatattggagaggataactcgcgtttacatatgtgatagttatgcttaatactaattcacagagttggctcgatcattttgagattctagttgctttatctcaaagctttcactgaagggctgtaactgaaaattattaaatgttagtctttagtcaaatctctgcattgtttcatgcagaaaataaagatacaattaaggctgaaaaaaaaatct

SEQ ID NO: 457910 - DNA, 4319 bp, Homo sapiens
ctcgtaccaagcgtgtcgtagtggggctgttggggccccacagaaagtcagcggaacgtgaaatgggaaaggaatcatgcgactctgtaataagaagctgacagaaccatgaaggatcagggactgaaagcattagataagttgttagtgggatgcaggttccacaggcaagcggaacgattcaagcgaattagtaaagtttctgcccggatcttgaaagccgcttccgttgctcagcggaagtgtcggtcgcaagaggacagacgcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccatttaaaatacaaaatcctattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgttcatactgctactttcccatgtttcctatatgcctcccctatattggagaggataactcgcgtttacatatgtgatagttatgcttaatactaattcacagagttggctcgatcattttgagattctagttgctttatctcaaagctttcactgaagggctgtaactgaaaattattaaatgttagtctttagtcaaatctctgcattgtttcatgcagaaaataaagatacaattaaggctgaaaaaaaaatct

SEQ ID NO: 457911 - DNA, 3513 bp, Homo sapiens
ctcgtaccaagcgtgtcgtagtggggctgttggggccccacagaaagtcagcggaacgtgaaatgggaaaggaatcatgcgactctgtaataagaagctgacagaaccatgaaggatcagggactgaaagcattagataagttgttagtgggatgcaggttccacaggcaagcggaacgattcaagcgaattagtaaagtttctgcccggatcttgaaagccgcttccgttgctcagcggaagtgtcggtcgcaagaggacagacgcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccatttaaaatacaaaatcctattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgactcagatttagggtttaaagactattgaga

SEQ ID NO: 457912 - DNA, 2602 bp, Homo sapiens
ctcgtaccaagcgtgtcgtagtggggctgttggggccccacagaaagtcagcggaacgtgaaatgggaaaggaatcatgcgactctgtaataagaagctgacagaaccatgaaggatcagggactgaaagcattagataagttgttagtgggatgcaggttccacaggcaagcggaacgattcaagcgaattagtaaagtttctgcccggatcttgaaagccgcttccgttgctcagcggaagtgtcggtcgcaagaggacagacgcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtat

SEQ ID NO: 457913 - DNA, 3200 bp, Homo sapiens
ctcgtaccaagcgtgtcgtagtggggctgttggggccccacagaaagtcagcggaacgtgaaatgggaaaggaatcatgcgactctgtaataagaagctgacagaaccatgaaggatcagggactgaaagcattagataagttgttagtgggatgcaggttccacaggcaagcggaacgattcaagcgaattagtaaagtttctgcccggatcttgaaagccgcttccgttgctcagcggaagtgtcggtcgcaagaggacagacgcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccatttaaaatacaaaatcctattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgttcatactgctactttcccatgtttcctatatgcctcccctatattggagaggataactcgcgtttacatatgtgatagttatgcttaatactaattcacagagttggctcgatcattttgagattctagttgctttatctcaaagctttcactgaagggctgtaactgaaaattattaaatgttagtctttagtcaaatctctgcattgtttcatgcagaaaataaagatacaattaaggctgaaaaaaaaatct

SEQ ID NO: 457914 - DNA, 263 bp, Homo sapiens
agtctatgctttaaaaatgagccttctttcaactgttatatactttttaaagttccatggaatcttttagggtttttcttcatatataatgacacggaggaattgctaaaaccatgcaccaggtgctatacattgtcatcaaagtccatgcccatttgcaaatgtacagtgtatggccagactgagaataatgatttatgttcaggtcaaaatcctgcccaggcaggaagaccctgcgctatttaacacagtctgatttcact

SEQ ID NO: 457915 - DNA, 1380 bp, Homo sapiens
gttttttgtttttaattaaaaaaaatttttttagctgattgtgttgggttgaggttgctttctggggaagaaaaggtgtaggagttgagacatctggagatagcaggaatggctgagtttttcttttgtgtctcctttaagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggtagattttccccaccctgcttaaggctccacagggccaagggtcttcagctgtcagaacccgggttctgagtagcatagggcaagaaagcacagaagtatagattgggccctatgggactgtttgtgcttacagtggcagggggcaggactggtatccatgctgtggctggctggagacttggcactgctcccagacaactcccacccaagctctttagctgcctctatttcccttcagcatgagcatttggggaatgatggtgactggtgacacctctgccctgagaaccccgccacagaacctacttctttccctctcctgccctggcctccccactcaccacctttctgctgtgtccctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaaggtaagtgtgaacagggcatctcactcaccacccctctatccttataggcattcctgccctggaggcccacctcctgcatgtgttggggcccttctactgtctgctggtgctcgcctccccacaccaccagcttgcttcccttgtctctgcctccccagactgcctgccttccttggtagatgatctggttccacgactgggcttaaagatcagcttagaaacaaggaggagaggccaggtgtggtggctcacgcctgttatcccagcactttgggaggctgaggcaggcggatcacgaggtcaggagttctagaccagcctggccaatatggtgaaaccccatctccactacaaatacaaaaattagccaggcgtggtggcacgggcctgtagtcccagctactcaggaggctgaggcagaagaatcgcttgaacccaggagacagaggttgcagtgagccgagatcgtgccactgcactccagcctgggcaacagagcgagactctatctc

SEQ ID NO: 457916 - DNA, 1034 bp, Homo sapiens
ctggaatttagaccagacttacaggctttctgctccttccttcagtgaagaagagtctccagggtccctctagtgcaggtcaaagaagtccagtccagctgagttcagctccctagggcctccccagccagtctcctggaccaagagctggctttgcaagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaaggtaagtgtgaacagggcatctcactcaccacccctctatccttataggcattcctgccctggaggcccacctcctgcatgtgttggggcccttctactgtctgctggtgctcgcctccccacaccaccagcttgcttcccttgtctctgcctccccagactgcctgccttccttggtagatgatctggttccacgactgggcttaaagatcagcttagaaacaaggaggagaggccaggtgtggtggctcacgcctgttatcccagcactttgggaggctgaggcaggcggatcacgaggtcaggagttctagaccagcctggccaatatggtgaaaccccatctccactacaaatacaaaaattagccaggcgtggtggcacgggcctgtagtcccagctactcaggaggctgaggcagaagaatcgcttgaacccaggagacagaggttgcagtgagccgagatcgtgccactgcactccagcctgggcaacagagcgagactctatctc

SEQ ID NO: 457917 - DNA, 258 bp, Homo sapiens
aaaagcaacagtggggagacagaaaggcaacttttgccaatgagccactaaaatatgggccaattttttggccaaatcatccaaatgactgtgcaaaggtatttgtctggcatccaccaagtttgcccaatcagtggaacgttagcaatcccctgctctccttcccagcattgagcccttggttgcctgggcccaggctgggggttttcagtatttgtaagcatttcagcagaacaataaagcctttggactacggaa

SEQ ID NO: 457918 - DNA, 3375 bp, Homo sapiens
tgccatggaactgggcaagcaacaggagggaagctgggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457919 - DNA, 5054 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagctccagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457920 - DNA, 3739 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggactggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457921 - DNA, 2071 bp, Homo sapiens
gagcgagataaaaaaaaaagtttaaatgattttatcaggatcacagagcccatagtggtagcggggccagggtttgaagtcaggacagtcatgcttaaagcatttctctttaaccagccagggctcttggagagggtgggctttgaagatgatgcctcctcatgccagactaccctgaggtggattcctcctgcagccctgcccaggtgtgaagagggccagtggggggaagaggatggccataggtgctgaccccttggctttgggggcaggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457922 - DNA, 4819 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457923 - DNA, 1435 bp, Homo sapiens
  misc_feature (15)..(15): n is a, c, g, or t
  misc_feature (49)..(51): n is a, c, g, or t
ggctcggtaccgggncagtacggatgtgtactacgaccacctgcgcagnnnacaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457924 - DNA, 1461 bp, Homo sapiens
tagagcgaatcccccgcggtccagttacagatctgtacgtatcgaccaccgtgcgcggtgcagccagatcaagagtgttttatccgcttcactactcgtcactgagagccctgcaagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457925 - DNA, 4789 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457926 - DNA, 4243 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattactcccctgctctccttcccagcattgagcccttggttgcctgggcccaggctgggggttttcagtatttgtaagcatttcagcagaacaataaagcctttggactacggaa

SEQ ID NO: 457927 - DNA, 2543 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggagagggcggagctggccgcgggacggaggcacctggaggcccgccaggcgctctacgccgagctccagacgcagctcgataactgccccgagtcagtgcgggaacagttacaggagcagctgagaagggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggtgtgccccacctcgttccctgctgcgtgctgttggaggccagtgacctgggtttgaatcccaatgacctcacaaaagttaacttcgtcttttgtgcctggatttccttgtctgtaaaatgagaattacaacaggttgttgtgagaattaaacaagatgtaaagacaaaa

SEQ ID NO: 457928 - DNA, 2655 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggagagggcggagctggccgcgggacggaggcacctggaggcccgccaggcgctctacgccgagctccagacgcagctcgataactgccccgagtcagtgcgggaacagttacaggagcagctgagaagggtcagttccaccgccccccctcccccggccccgcgggccacgccccagaaggaagagaggagagcggtgggacgggaccacctggcctctgcagtacctgccggacaccagggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggtgtgccccacctcgttccctgctgcgtgctgttggaggccagtgacctgggtttgaatcccaatgacctcacaaaagttaacttcgtcttttgtgcctggatttccttgtctgtaaaatgagaattacaacaggttgttgtgagaattaaacaagatgtaaagacaaaa

SEQ ID NO: 457929 - DNA, 388 bp, Homo sapiens
ttgctgagaggaaactctggtcctcactggaaaagcctttgtgtttgatcctcttgatactcacttttgaacctggggcgccaaggaccagtgccccccttgtcagggtatagctctgtcagggtccagggagtttagagagcccaggactgctgtggtgtgagaagggaacatttcagcctggggctcacatggactggtagggtctaggctctggacctatttaggactaagctccagggctttctaggggctgggaggggaaagggcagatagggaggcaggtgagaatattcctgggcatgggtgagccccatcttagaccttcctctcttcctttggcagagcccgaacccagccctcaccttctgcgtaaagacccatgacc

SEQ ID NO: 457930 - DNA, 520 bp, Homo sapiens
gaaggcagtggatcagctgcaggagaagctggtggccttggagacaggcatccagaaggagagggacaaggtaacccacacctggcccagcttagtgctgggtaccagtggcctgggagagaaggagaaatgtcttctctggggccctgtacccttcacctcatcatccattctgcagtacaagtggtctctgtggctttccagagacagagtgacttctcctcctctgtggaaggaaccagcttggagggcactgccaggggctgggctggtgtctggggtctcctctgtctgggtctgtgtgctacctctgggtgcctgccatcctaggccctttatggcccttctaggaagtgccaaagccccttcttgggcagtgagcacagcccaagggactgacattggggagtgattcaagttcgggtcccaccatctggagaacatctccctccaagcatgccacaagtgcttacgttgtgatctttgggagatggccctcgggcctctgcttcccttgagc

SEQ ID NO: 457931 - DNA, 259 bp, Homo sapiens
ctccctaaagtcaaagacctttgcatttccctccagcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcc

SEQ ID NO: 457932 - DNA, 411 bp, Homo sapiens
cgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaaaagtgagtggaaggccggtg

SEQ ID NO: 457933 - DNA, 564 bp, Homo sapiens
gctccttgatgcacttcctcttccccttctctccccagcgcgagtggtctggacatggggaagatcgaggagatggagaagatgctgaaagaggctcatgcagagaagaaccggctcatggagtcgagggtgagtctgacctggatcggggaggcagaaggtgttggggcacagagctacctactgcatgtcaagggcctgtgctccaccccaagcccttccacccacattagccttgccacattcccttggggtagaaaatgttttaaaaggttgtattctggccgggcgcggtggctcatgcccgtaatcccagcacttcaggtggccgaggcaggcggatcacgaggtcaggagatcgaaaccatcctggctaacacggtgaaaccccgtctctactgaaaatacaaaaaattagctgggcgtggtggcaggcgcctgtagtcccagctgcgcgggaggctgaggcaggagaatggcgtgaacccgggaggcggaggttgcagtaagccgagatcgcaccactgcactccagcctgggagacagagcgagactccgtctca

SEQ ID NO: 457934 - DNA, 4874 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457935 - DNA, 4736 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457936 - DNA, 4498 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457937 - DNA, 4795 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtatacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457938 - DNA, 5167 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaaaaaaaaaaaaaaaaaacaaaaaaaaaaaaaaaaaaaaaaaaaaaaaaaaaaaaaaaaaaaaaaaaaaaaaaaaaaaaacaacatacaaaatagcgaagaacaagaacaacacagtagagatagaccaatgagcaccaggtcactcgaaagcttcttcaactgtattgagagagcgcaatttcagcacataataattatatagggcagtgggagtataccacaaatacgaatagtatggaaatctgtagctactgaactccggctactgttggggctgacatacttatgtgata

SEQ ID NO: 457939 - DNA, 5145 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaaaaaaaaaaaaaaaaaaaaaaaaaaaaaaaaaaaaaaaaaaaaaaaaaaaaaaaaaacaacatacaaaatagcgaagaacaagaacaacacagtagagatagaccaatgagcaccaggtcactcgaaagcttcttcaactgtattgagagagcgcaatttcagcacataataattatatagggcagtgggagtataccacaaatacgaatagtatggaaatctgtagctactgaactccggctactgttggggctgacatacttatgtgata

SEQ ID NO: 457940 - DNA, 4599 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 457941 - DNA, 3186 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggctgaagctttgagatggaagagcgagaatgagcaggggactccctaattcttcagcagatggatggaattcaggtaggcatca

SEQ ID NO: 457942 - DNA, 2964 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgctcccctgctctccttcccagcattgagcccttggttgcctgggcccaggctgggggttttcagtatttgtaagcatttcagcagaacaataaagcctttggactacggaa

SEQ ID NO: 457943 - DNA, 1815 bp, Homo sapiens
ccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggtgagcgggtgccagggaggcttgccactgtccatggcagagtctctgccagggctcgagcaggccagctggcagagcaggagaggccctcaaacagggcttcggcttctcaaggttccccacctccaggatacactttagtgatcaatatcttatggttctggtgccgtgaagaagaaattcctttgaaatctctaagactttattttaaattcttgctaattttgcatttattcaacatagcatttgttttaatgttaaattaaatttcacattgtt

SEQ ID NO: 457944 - DNA, 392 bp, Homo sapiens
ctccagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtaacccctccttcactgcccgtcctccccagcctttgcacctgtccactctgatacctcctgccaatccatcagccacacagtaccaccttgagtggaggcgtcagcccagtcagggcaatgagggcacctctgggccctgagagggtcactccttgggcagccatcctggcatgtgggcaaccggggggccagcctccatagtctaaaactatctgattgagtgtctggtggaagaggattct

SEQ ID NO: 457945 - DNA, 400 bp, Homo sapiens
ctgtggcctggtcttccaggcccagagtggcattgcaagcaccacccaaccccctttgtcactgtcgttgaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggtgtgccccacctcgttccctgctgcgtgctgttggaggccagtgacctgggtttgaatcccaatgacctcacaaaagttaacttcgtcttttgtgcctggatttccttgtctgtaaaatgagaattacaacaggttgttgtgagaattaaacaagatgtaaagacaaaaa

SEQ ID NO: 457946 - DNA, 1388 bp, Homo sapiens
aagctgcactcctcaggcttccggtcttgtggaccgaggctcctctccaatcgtcctaaagcaactgaaggaacaattgataacaatttaaacatgttaatttatttaatctgatttggttgttaaaacagccttaaaactctcattcctatttcccagcaattgcaagagacgcctccgcggagccggcgctcagatgccaaaggctggagtcgttggtgacgtcatccagggctgggctatgcggggtggggccaagaagcaggaccaaagttccggtatgcgcgctttcagtcttcaattaggtccgaattcccggcatataagggcgttgctttgccttagcgtgaggtttcttaagttggttttagaagttgcttagtcatgtctggccgtggtaaaggtggaaaaggtttgggtaagggaggggctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcagttctgtggctcctgatggatctgagaagatggacgtggaggatgaaaatctgtctgattattttgaactgatgtttgttgctatggagatgctgcctatatgttgatgttgcagacgttaagtcactagcccacagccttgtattccatactcagagaccctgctacttacttgacatctcaacttgaaagtccaattaatatgcacttcaaactttaataggcttcaaacagaatttctttcattatctctgcaaaacagcttctctcatcatcttgaaattagtgaatggcattttactgttttagttggagtcatttctgtggttttctttcacatcctacataacaatccatcagtaagttctatgagctcttctttgaaaacaaacagaatccaactgtttcattcccacttctgctctggtcaagccactgccaacactcacctttattattgtagcaccctcattgcctagttctgtcccacagatttccaataaaaggtgaataaaatcaggtcactcttctgctgaaaa

SEQ ID NO: 457947 - DNA, 665 bp, Homo sapiens
tggaaacttcgcggagagactgcaagttaccctttccaaaatggcgggaagggctaaaaacaaagaaagctcgcacccagacggcgggccttaaaccaaggcgaatccgtgagcgcaacacatctgcttctgtggctcctgatggatctgagaagatggacgtggaggatgaaaatctgtctgattattttgaactgatgtttgttgctatggagatgctgcctatatgttgatgttgcagacgttaagtcactagcccacagccttgtattccatactcagagaccctgctacttacttgacatctcaacttgaaagtccaattaatatgcacttcaaactttaataggcttcaaacagaatttctttcattatctctgcaaaacagcttctctcatcatcttgaaattagtgaatggcattttactgttttagttggagtcatttctgtggttttctttcacatcctacataacaatccatcagtaagttctatgagctcttctttgaaaacaaacagaatccaactgtttcattcccacttctgctctggtcaagccactgccaacactcacctttattattgtagcaccctcattgcctagttctgtcccacagatttccaataaaaggtgaataaaatcaggtcactcttctgctgaaaa

SEQ ID NO: 457948 - DNA, 1055 bp, Homo sapiens
  misc_feature (907)..(907): n is a, c, g, or t
  misc_feature (1055)..(1055): n is a, c, g, or t
aagctgcactcctcaggcttccggtcttgtggaccgaggctcctctccaatcgtcctaaagcaactgaaggaacaattgataacaatttaaacatgttaatttatttaatctgatttggttgttaaaacagccttaaaactctcattcctatttcccagcaattgcaagagacgcctccgcggagccggcgctcagatgccaaaggctggagtcgttggtgacgtcatccagggctgggctatgcggggtggggccaagaagcaggaccaaagttccggtatgcgcgctttcagtcttcaattaggtccgaattcccggcatataagggcgttgctttgccttagcgtgaggtttcttaagttggttttagaagttgcttagtcatgtctggccgtggtaaaggtggaaaaggtttgggtaagggaggggctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcaggtaacgtttaattactcgtgcttaatctcgcatgtttaggatttgggcataaagtanttaaagccactgttttctgcttgagggaagttggtatgttgaatatgtttagctttcttgtggcattttaacactagatatcagtgagtaagctggattgtgacagtttataattcccgtgggccttcctccttcagtttaagctgan

SEQ ID NO: 457949 - DNA, 6764 bp, Homo sapiens
aattcggcactagggcttgatgactataatgggcccagttgtctgcgggctgcggggagctaagtccccagattggaggaggctggctctggtcttcgatgcacaggagtggccgttatggaacgccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457950 - DNA, 767 bp, Homo sapiens
gaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatgcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagc

SEQ ID NO: 457951 - DNA, 438 bp, Homo sapiens
cctcccaaagtgctgaaattacaggtatgcgccactgtgcccagccaagctaatatttctaactgtcattatttctcattctacatgacagccccttcatatcccaaatttacaccagtgtctatagtaggtctcctaatgtttctaagggccagacatggtggctcatgcctgtaatcccagcactttgggaggctgaggcaggccaatcgcttgagcccaggagtttgagacctgactgggcaacatggcgaaatcccacctctgccaaaaatacaaaaatcagctgggcatgatggggctgcacctgtagtcccagctgttcggaggctgaggtgggaggatcctgtgggtccagacattgaggcttcagtgagccatgattgcgcctctgcgctccaacccaggtgacagagcaagactctatctcaaaaaaaa

SEQ ID NO: 457952 - DNA, 6791 bp, Homo sapiens
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457953 - DNA, 6917 bp, Homo sapiens
cgtccatcagaggacgcagtactccctgtgatttatattttctgccccaattttgccttctccacaaattttataccgtttgtagctgcctactctagattacttcacctttccagactatcagttcttccacctttattcttcataaagaaaattccaataacctgtttcacttaggtttttctattactcttcaagcatgaatcctaatttccctgactatatcttacctctgatctccataactgatgggagaagactggcgcatcttcgtcccatcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457954 - DNA, 6656 bp, Homo sapiens
ttggcctcccaaagtgctgggattataggcatacgccactgcacccagcctagtttcaatttttaatataagaaatatctataaatataacccacatacacgaaagctcttttggagtcctcaataatttttaaagattataacggggtcctgatataaaaatgtttgagcaccacagccctatactgtactgccttggggcagtggatacccaaaagctggttttatggttatagaagcagcttagaagtcagctccatttctgagacctgtcacataaaaatgtgtccttccttttctcctgtgaagctggacttaataatgctgacattctggggtggctctcatttaattatgagagactgcaaggcaagtgcttagtgtagagtaagccctcaacccatggcccagaaccaggaacttttcttgtgtcatccacaggtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457955 - DNA, 6431 bp, Homo sapiens
aattcggcactagggcttgatgactataatgggcccagttgtctgcgggctgcggggagctaagtccccagattggaggaggctggctctggtcttcgatgcacaggagtggccgttatggaacgccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457956 - DNA, 6652 bp, Homo sapiens
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457957 - DNA, 6209 bp, Homo sapiens
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgctgagacaggagaatcgcttgaaccggggaggcagaggttgcagtgagccgagatcacgccattgcac

SEQ ID NO: 457958 - DNA, 6086 bp, Homo sapiens
  misc_feature (5955)..(5955): n is a, c, g, or t
  misc_feature (5960)..(5960): n is a, c, g, or t
  misc_feature (5964)..(5964): n is a, c, g, or t
  misc_feature (5966)..(5966): n is a, c, g, or t
  misc_feature (5968)..(5968): n is a, c, g, or t
  misc_feature (5970)..(5970): n is a, c, g, or t
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaaggganggganagcngngncngaagtggcgggtaactttatacttaacttgggacagaaaacttgcggcaggacagcccagttgtggcacaccaaagtgtggcaaccgggccaccggagacaatagtggggcagggg

SEQ ID NO: 457959 - DNA, 4668 bp, Homo sapiens
aatttaaaaatatttcatacaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457960 - DNA, 1755 bp, Homo sapiens
  misc_feature (18)..(18): n is a, c, g, or t
  misc_feature (35)..(35): n is a, c, g, or t
  misc_feature (44)..(44): n is a, c, g, or t
aagtgccttactttaggnggctggaccacctcaantttagaaanacaccccttgcggtgttttaaaaaaaagcagtcgtacggtcggaattcccgggatatcgattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457961 - DNA, 853 bp, Homo sapiens
agcggcgtcatcgcacagggaaatctttctggaaccgggcaccaacttgcgtgtttgttttcatgctctttgtgcggggattagctgtcgtgccgggcctgaaaatgctgcgagcgccgggcgacatctaatccaggatttgcctctgcctcgcggttgatggaaaacagatgtcttactgctctgggcctgagcacagaatggaaatgaccgaccagagagccatttggagccgaggacacccggtgaaagccattcagagtccagccaggaggccgactttcctcctctgcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagc

SEQ ID NO: 457962 - DNA, 2727 bp, Homo sapiens
gaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatgcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagcaaaaagactacctgctcactttctttgaccagaactatttaaataacgaaatcaatctccactgtgtctccttcacacatattgttggtatccccaggacagcaaaccagtagctatttgcaagctgacctacataaacatctgtgtaataaatttatggatacggatttaacaatggataagttctgtaagttgagaatgattattaaaatgttaattagagttctttatttttcttgggagggaaattttctcatgctacattagaccttattccttattaatagatagaatttgaagctatgtgaatccctgatagtagattatagattatgaattccaaacatatttcttgctactagtgagtacaataactgttagaagctcaggaggacctgtgggtaccatcaagtaactgattcacaatagctatgtaacctgaagaggcagcattgtgtagcgtctaaggacattggctttggagtcaggctgcctgattcaaatcctgctcttaaacttattccctgtgccagctttggtaagtttattaaactctctgcgtctcatttctttatcagttaaaaaaaagtaataatagtatttaccatatagaatattggaagaattaaatgttcaagtcatgtaaatcatatagtaggatcttgataaatgtcagctttaacattttttcattaattactttatattcatctcatttgtatattggtcacttcaaaagtatttgaaactgcttaaaacaaaaggcccaggtataacaaaaccactaagacaagcaagcaatcattagagcaaagcaattcttattagccacactactgtttgtttacctcatctcccagcattctctctgcacactgtgctggagcctcaccagcctcctagaacctgccaaatggtttccctcctcggggcctggctgttctgttccttctgcctgggttgctctttgtttcctctttatgtggcgagcttattctcttccttgaagtctcactgcaaatttctcctgcacacagcagtcttctccacctgtaccgtctaacacaggttgcctcttacagctggttaccctccatcatgtccctgctttctttcctccctggtgctcactgtggtctgcttgccatcagctgtgtatttgtgtacttattagtcctggctttccctctagaatgtgagctctgggagggcaaggacctgtcattagacccctagcactgagggcagtgtcttatacatagaagtcaataaatatttgttgaacaaatttgccagacaccgtatttggctccttaaacccccctctgcaaagtagttgttggttactttcactttataagatgaagaaactgaggctgaaacagtttaagtcacaaagcttgctgggcacattgtaaaagctagccctggaagaaatagcatcctgagctttctggtagccaaaacaagagaaggacaccatggcttacacatctgtaataatttaattgaaagcacaccaggctattaatagctatcagttttccatgcattttatgccaagggaaattgatcatctaaattttgtaaaaagaacttttaaatgctgcttttgaaagcaggttgagtattttcctcatgaccacttctcacactggtgcttagtgaatgctgaggctgtctatgcctggagcttgcactctaaatactagttatgggaaggtatttctatcaggtgtaagagtgccccttaaaatgaggctctctggagacgtgacttgatagaggagtaaagtcttagaaacattaggttgttttattttttatgggttttttagtttttgtttttgtttctgagacagagtctcaatctgtcatccaggctggagcttcagtgagccatgattgcgcctctgcgctccaacccaggtgacagagcaagactctatctcaaaaaaaa

SEQ ID NO: 457963 - DNA, 1120 bp, Homo sapiens
  misc_feature (945)..(945): n is a, c, g, or t
  misc_feature (972)..(972): n is a, c, g, or t
  misc_feature (1013)..(1013): n is a, c, g, or t
  misc_feature (1031)..(1032): n is a, c, g, or t
  misc_feature (1064)..(1064): n is a, c, g, or t
  misc_feature (1077)..(1077): n is a, c, g, or t
  misc_feature (1086)..(1087): n is a, c, g, or t
aattcggcactagggcttgatgactataatgggcccagttgtctgcgggctgcggggagctaagtccccagattggaggaggctggctctggtcttcgatgcacaggagtggccgttatggaacgccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcgtnccacaactggaacgctgcagtgcagtngtgagggcagttagcagccgccccttctgcatcctgtcaantctgattagttagagttnnggctcaaaagagtgggtggactgagattgaanttgggttgtgcangagaaaggnnaggagacacttagtaccaccagtttcagcaata

SEQ ID NO: 457964 - DNA, 2746 bp, Homo sapiens
  misc_feature (409)..(409): n is a, c, g, or t
  misc_feature (526)..(526): n is a, c, g, or t
agcggcgtcatcgcacagggaaatctttctggaaccgggcaccaacttgcgtgtttgttttcatgctctttgtgcggggattagctgtcgtgccgggcctgaaaatgctgcgagcgccgggcgacatctaatccaggatttgcctctgcctcgcggttgatggaaaacagatgtcttactgctctgggcctgagcacagaatggaaatgaccgaccagagagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggngaggagcgggtgcgaagtcctgggtcgcctgcccgctgcctgatgtcgtgagctagggcacctcggccctggctgggcgcgcagcgaggcccaggcccgaggggtgaggcccaggcnactccggagcgcgcgctgttcccgcgaagcgagtcgccgtctcgtacagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacgtacatcagagattacagattgaaacagaactccatgtggaaaaatcagtaattaaaaaagatttttaccagcaaaaagactacctgctcactttctttgaccagaactatttaaataacgaaatcaatctccactgtgtctccttcacacatattgttggtatccccaggacagcaaaccagtagctatttgcaagctgacctacataaacatctgtgtaataaatttatggatacggatttaacaatggataagttctgtaagttgagaatgattattaaaatgttaattagagttctttatttttcttgggagggaaattttctcatgctacattagaccttattccttattaatagatagaatttgaagctatgtgaatccctgatagtagattatagattatgaattccaaacatatttcttgctactagtgagtacaataactgttagaagctcaggaggacctgtgggtaccatcaagtaactgattcacaatagctatgtaacctgaagaggcagcattgtgtagcgtctaaggacattggctttggagtcaggctgcctgattcaaatcctgctcttaaacttattccctgtgccagctttggtaagtttattaaactctctgcgtctcatttctttatcagttaaaaaaaagtaataatagtatttaccatatagaatattggaagaattaaatgttcaagtcatgtaaatcatatagtaggatcttgataaatgtcagctttaacattttttcattaattactttatattcatctcatttgtatattggtcacttcaaaagtatttgaaactgcttaaaacaaaaggcccaggtataacaaaaccactaagacaagcaagcaatcattagagcaaagcaattcttattagccacactactgtttgtttacctcatctcccagcattctctctgcacactgtgctggagcctcaccagcctcctagaacctgccaaatggtttccctcctcggggcctggctgttctgttccttctgcctgggttgctctttgtttcctctttatgtggcgagcttattctcttccttgaagtctcactgcaaatttctcctgcacacagcagtcttctccacctgtaccgtctaacacaggttgcctcttacagctggttaccctccatcatgtccctgctttctttcctccctggtgctcactgtggtctgcttgccatcagctgtgtatttgtgtacttattagtcctggctttccctctagaatgtgagctctgggagggcaaggacctgtcattagacccctagcactgagggcagtgtcttatacatagaagtcaataaatatttgttgaacaaatttgccagacaccgtatttggctccttaaacccccctctgcaaagtagttgttggttactttcactttataagatgaagaaactgaggctgaaacagtttaagtcacaaagcttgctgggcacattgtaaaagctagccctggaagaaatagcatcctgagctttctggtagccaaaacaagagaaggacaccatggcttacacatctgtaataatttaattgaaagcacaccaggctattaatagctatcagttttccatgcattttatgccaagggaaattgatcatctaaattttgtaaaaagaacttttaaatgctgcttttgaaagcaggttgagtattttcctcatgaccacttctcacactggtgcttagtgaatgctgaggctgtctatgcctggagcttgcactctaaatactagttatgggaaggtatttctatcaggtgtaagagtgccccttaaaatgaggctctctggagacgtgacttgatagaggagtaaagtcttagaaacattaggttgttttattttttatgggttttttagtttttgtttttgtttctgagacagagtctcaatctgtcatccaggctggagcttcagtgagccatgattgcgcctctgcgctccaacccaggtgacagagcaagactctatctcaaaaaaaa

SEQ ID NO: 457965 - DNA, 2383 bp, Homo sapiens
gtccttgactacccaagtgagaagtcagcagagcctggggacgccatgtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagcaaaaagactacctgctcactttctttgaccagaactatttaaataacgaaatcaatctccactgtgtctccttcacacatattgttggtatccccaggacagcaaaccagtagctatttgcaagctgacctacataaacatctgtgtaataaatttatggatacggatttaacaatggataagttctgtaagttgagaatgattattaaaatgttaattagagttctttatttttcttgggagggaaattttctcatgctacattagaccttattccttattaatagatagaatttgaagctatgtgaatccctgatagtagattatagattatgaattccaaacatatttcttgctactagtgagtacaataactgttagaagctcaggaggacctgtgggtaccatcaagtaactgattcacaatagctatgtaacctgaagaggcagcattgtgtagcgtctaaggacattggctttggagtcaggctgcctgattcaaatcctgctcttaaacttattccctgtgccagctttggtaagtttattaaactctctgcgtctcatttctttatcagttaaaaaaaagtaataatagtatttaccatatagaatattggaagaattaaatgttcaagtcatgtaaatcatatagtaggatcttgataaatgtcagctttaacattttttcattaattactttatattcatctcatttgtatattggtcacttcaaaagtatttgaaactgcttaaaacaaaaggcccaggtataacaaaaccactaagacaagcaagcaatcattagagcaaagcaattcttattagccacactactgtttgtttacctcatctcccagcattctctctgcacactgtgctggagcctcaccagcctcctagaacctgccaaatggtttccctcctcggggcctggctgttctgttccttctgcctgggttgctctttgtttcctctttatgtggcgagcttattctcttccttgaagtctcactgcaaatttctcctgcacacagcagtcttctccacctgtaccgtctaacacaggttgcctcttacagctggttaccctccatcatgtccctgctttctttcctccctggtgctcactgtggtctgcttgccatcagctgtgtatttgtgtacttattagtcctggctttccctctagaatgtgagctctgggagggcaaggacctgtcattagacccctagcactgagggcagtgtcttatacatagaagtcaataaatatttgttgaacaaatttgccagacaccgtatttggctccttaaacccccctctgcaaagtagttgttggttactttcactttataagatgaagaaactgaggctgaaacagtttaagtcacaaagcttgctgggcacattgtaaaagctagccctggaagaaatagcatcctgagctttctggtagccaaaacaagagaaggacaccatggcttacacatctgtaataatttaattgaaagcacaccaggctattaatagctatcagttttccatgcattttatgccaagggaaattgatcatctaaattttgtaaaaagaacttttaaatgctgcttttgaaagcaggttgagtattttcctcatgaccacttctcacactggtgcttagtgaatgctgaggctgtctatgcctggagcttgcactctaaatactagttatgggaaggtatttctatcaggtgtaagagtgccccttaaaatgaggctctctggagacgtgacttgatagaggagtaaagtcttagaaacattaggttgttttattttttatgggttttttagtttttgtttttgtttctgagacagagtctcaatctgtcatccaggctggagcttcagtgagccatgattgcgcctctgcgctccaacccaggtgacagagcaagactctatctcaaaaaaaa

SEQ ID NO: 457966 - DNA, 597 bp, Homo sapiens
ggtaccatatttggttggacgacaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaaggagagggcttctgtgcccgacgcctgagctggcactggttaaggggtaactgggcacgtgtcattgcaaatagcaacactgcagcccagaactctacctgcaggtgttaggagatgtactgctataaaatttgatatattttgttagtcgagcttatgcagtctcctccagagatggtatttccttc

SEQ ID NO: 457967 - DNA, 6844 bp, Homo sapiens
gaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatgcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457968 - DNA, 7512 bp, Homo sapiens
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctccaaaaaaaaaaaaaagaaaaaaaaaaaaaaaatttttgggcggtttgggcctaggaaaaggtttttaagaaacaattttggttggggggggggccaggaggtaggggaaaagggaaagggggtccacaaggaaaatcccggggccacgaacaacaggagcgtgggagattccatccccaaattaaaaaaaggccggtcgagaacaaccaggagcgtttgtagaacaaattcaacaatggcgagttcagcagcgcacaatacgggactctatcacacaggggaccaaggaaaacgctcgatattatcaaaataaccccccgaccagtggagaattcaaaaataacacaagaaaagctacacacacgatcacacaccgaacagatagcaatgtcaacagaaacaaggaggcagagggagaacgggagaggggatccgagcagtgaacagacatagtgcgagaagacagagaagagaggaggagaacaaaagaacagccgaagatctcgacaaaacagagcggacgaggacgaagagaagctacgacagcggaacgacaagagggaaaaaagacggcggtagaggagagcaagaaagagcagaaggacaagagcgtgataggagagacagacggagaggggaagggagaagaacagaaagcaaaggcgcaggggagccgcaaggaaagaggaagatgagaagagagaaaaaagaaaatagagaagg

SEQ ID NO: 457969 - DNA, 6160 bp, Homo sapiens
  misc_feature (409)..(409): n is a, c, g, or t
  misc_feature (526)..(526): n is a, c, g, or t
agcggcgtcatcgcacagggaaatctttctggaaccgggcaccaacttgcgtgtttgttttcatgctctttgtgcggggattagctgtcgtgccgggcctgaaaatgctgcgagcgccgggcgacatctaatccaggatttgcctctgcctcgcggttgatggaaaacagatgtcttactgctctgggcctgagcacagaatggaaatgaccgaccagagagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggngaggagcgggtgcgaagtcctgggtcgcctgcccgctgcctgatgtcgtgagctagggcacctcggccctggctgggcgcgcagcgaggcccaggcccgaggggtgaggcccaggcnactccggagcgcgcgctgttcccgcgaagcgagtcgccgtctcgtacagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457970 - DNA, 6415 bp, Homo sapiens
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaatcatgtttgttttggaatgggatgtctgcaccaagggggtctggaaaaatcttaaacgtcgcaattttgattaagctttttaataagggttaggggggtttaatgggacatta

SEQ ID NO: 457971 - DNA, 2642 bp, Homo sapiens
aattcggcactagggcttgatgactataatgggcccagttgtctgcgggctgcggggagctaagtccccagattggaggaggctggctctggtcttcgatgcacaggagtggccgttatggaacgccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcca

SEQ ID NO: 457972 - DNA, 2465 bp, Homo sapiens
aattcggcactagggcttgatgactataatgggcccagttgtctgcgggctgcggggagctaagtccccagattggaggaggctggctctggtcttcgatgcacaggagtggccgttatggaacgccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtactacaagcacatgagttgttgttaacttttaactgcttttatggagaaattggtctgcgagaaaataatgcaatacttacatatggcaccaaagggagttaaccagcagagtagactttgttctgctcaaagatgccggttttaacttggacttacagaccttggaaagtcaggaaattgaataaaatgtggtggcaataagttgcttaatttgaaactggtgcaaatgaagaggacttgaaaattaaattttaaaaagcaattcgttgaacttagaggcagaactttctgaagcttaatgttttgtggctagtcaataaattaaaatcactttttcaattttc

SEQ ID NO: 457973 - DNA, 1469 bp, Homo sapiens
aattcggcactagggcttgatgactataatgggcccagttgtctgcgggctgcggggagctaagtccccagattggaggaggctggctctggtcttcgatgcacaggagtggccgttatggaacgccagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcactgcatgcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagcctcgtgccgcctcgtgccggcacgaggctgatgttggagcggccg

SEQ ID NO: 457974 - DNA, 712 bp, Homo sapiens
cattactctattgatacaatattgtgcatgctagtgttgtatttctatacagtagcttgaaattgattaacttatactgtaggagtaatggaggagtaatcatttcactggagagacagtatcatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457975 - DNA, 623 bp, Homo sapiens
attgatacaatattgtgcaagctactgtatagaaatacaacactagcatgcaccaatatgtatcaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457976 - DNA, 242 bp, Homo sapiens
  misc_feature (19)..(19): n is a, c, g, or t
  misc_feature (23)..(23): n is a, c, g, or t
tctggtgttgtcatggtgnaatnaccccccccctccccccgaatattatcttatatacatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457977 - DNA, 3767 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457978 - DNA, 4041 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccaaaaaaaaaacacaacaacacagaacaaaaaaacaaaaccttgtgcggggccgcccctcgaccccgcagaaaaaggctttttaaacaccaatctgctgggggggggggggccccagtgtgtgattatgtgaccctgggccccacgcgggtcccagaagaacaccggcgcgacacaccggcttggcttccctcccaataaaaaacccgggcggcaccggcgtctgaacaactcaagtgggtcgaggcgtccggcctctccgcgcacagacgaaaat

SEQ ID NO: 457979 - DNA, 4040 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccactccgatctcgcaacacacagtccagcaaaacacaaaaaaaagggggggcgcccaaaaacccgaggggggccaccttctgcacacccaattgttgtacaagggccccaagagagcggcataataaacacagcagggcggggtaacaaccgcggtgggaaacgacgatcggctggtagcagacccacccggggtggtagtgagacacaccacaaacggccggagacaaagcttgtgtcaaccaactgtgagagctgtaatcaacagactatcag

SEQ ID NO: 457980 - DNA, 3884 bp, Homo sapiens
  misc_feature (3783)..(3783): n is a, c, g, or t
  misc_feature (3793)..(3793): n is a, c, g, or t
  misc_feature (3805)..(3805): n is a, c, g, or t
  misc_feature (3839)..(3839): n is a, c, g, or t
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccaaataaaaaaaaataanaattaattantatttataattntattatatttaaaatatatttttatatattattntattataaattaaaaaaaaaaatggccgatttttaacacattgag

SEQ ID NO: 457981 - DNA, 3709 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457982 - DNA, 885 bp, Homo sapiens
ccggttaagttttttctcattaaccgaaggatacactctggagtcgacccacgcgtcctgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457983 - DNA, 3532 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgatttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457984 - DNA, 3713 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457985 - DNA, 2708 bp, Homo sapiens
  misc_feature (2478)..(2478): n is a, c, g, or t
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactgacaattaacagcccaccaaaaaaaaaaaaaaaaaaaaaaaaaaacaacaacaaccaccaaaaaacaaaaaaaaaaccaaaggggggggggggcgaaaaaatccccgggggggccccataccccccccttttttttcaacgggggcccccaggggggggcaaaaaaaacagggccggggcggtaacacccgggctgcgtcgagacaccgcgctccggggcctttggagagaacccctnctctcgtggggggcgacttgcgcgcccctcccaagaattaaccgcgacggaatcaaacgcgtttcggtcgggacccctatccttcgcgacaattctgcccgattcttaataccggctgcatactaccgcatcaccaagcctcaatcgaatacgctttcacacatctctcatcaccacataacaggcaatcatgaccaacacgtctctcgacaagatacaaaatcacacgg

SEQ ID NO: 457986 - DNA, 1859 bp, Homo sapiens
  misc_feature (1715)..(1716): n is a, c, g, or t
  misc_feature (1734)..(1735): n is a, c, g, or t
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtnntggttcataggtgctcgnnaggtggctgtgggattttttttgtgggaaggtcttaacctacaaattcaatttattaaatagatacaattggctatcaagttatctatttcttcgtgagtgatttttggtagtttgtgttgttc

SEQ ID NO: 457987 - DNA, 596 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatgctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457988 - DNA, 3053 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggtttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 457989 - DNA, 3850 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccacggtcaaacacaaacaaatcaacacaacaaaaaaaaacaatttttggggcgccttgggctacagaaaagttcttttaaaaccg

SEQ ID NO: 457990 - DNA, 3859 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccatgacgccagtgctccttagcttcattgtgtgagttttactgtcctttgcttttgaaggttggatcagatgttggtgttctcttccctcccca

SEQ ID NO: 457991 - DNA, 3748 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgttaccatttccaccgcccaaacaataattaaatgtccagcaaggtggttactcaacacacttcctagaaagcgaaccaagcatgtcagttccgtccctgacggaatgtatttaaaaagcagtacatcacgcagctatcgaacctagagctgcaatgcatacagactt

SEQ ID NO: 457992 - DNA, 3913 bp, Homo sapiens
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttgggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttgggggggggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcaaatagtgattgtaacaaaattatttggtttgggatgtggctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccatgacgccagtgctccttagcttcattgtgtgagttttactgtcctttgcttttgaaggttggatcagatgttggtgttctcttccctcccca

SEQ ID NO: 457993 - DNA, 1893 bp, Homo sapiens
  misc_feature (1715)..(1716): n is a, c, g, or t
  misc_feature (1734)..(1735): n is a, c, g, or t
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtnntggttcataggtgctcgnnaggtggctgtggggattacctttattgggccttctttccctctttaaaggtaatccacccccaaaatttttaatcctctgagaagaacgttgaaggcccaaaatatagaaatcccggttgttgtaaagggcggggggatcaaaaaaccggtttagaat

SEQ ID NO: 457994 - DNA, 1215 bp, Homo sapiens
  misc_feature (755)..(755): n is a, c, g, or t
gcagggggttgtccgtcagtggcacgcacagcagcgcgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccctggcctcgaggtttagttttacaaattanaaaacattgttcttggttttacaaacaacacagcgaaaaaaaaataaaaacataaaacacaaaagacaaacatcagtcaataacaaaaaaacagagaggggggcgggggggcaaaaaagaattatcaccccgggggggcgccacaaattagccgccccaccgcttttttgtttacgaaaagcgagggcgccccccaatgggggggcgcgatcatattaataagcacaacggggagcggggcggccggcgtgtaaaaacaccgtcgcccgtggcgtgagcaccacggtgctacacggcggagactctcgaggaacaccccacaacctgggcggggcggagcagagtgggggcacccccccagcaggagatataaagccgccagggacaaaaaacctacggcgtatcggtgtgaacccacccgattgctcagggagaaatgtgcacggatgttggaaattag

SEQ ID NO: 457995 - DNA, 829 bp, Homo sapiens
gaaaaaaaacccttagatctgctcaactatcttgtaaattgcttggtgtaaaaacaatgtttgtagctcctggtctttcctgcacggcatttagcatataatgagtgcttaataagtaggtgcttcccacagaggacctgagctttgccaaaaaaggtttctacagttcagttaaactttcttgttaatatttttcctgtctttctttgaacccatttgagacaaatttttatgtttctccttttctgtaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgcta

SEQ ID NO: 457996 - DNA, 2023 bp, Homo sapiens
  misc_feature (421)..(421): n is a, c, g, or t
gcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcntgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgcta

SEQ ID NO: 457997 - DNA, 1121 bp, Homo sapiens
aagcatggtatcaacgcagagtgcccattacggccgggcacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgcta

SEQ ID NO: 457998 - DNA, 2225 bp, Homo sapiens
  misc_feature (421)..(421): n is a, c, g, or t
  misc_feature (2015)..(2015): n is a, c, g, or t
gcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcntgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaaaaaaaaaaaaaaaaaactcgagcacantgcgtaccacatgtttgtgatgggaaactggagtatccaacttgagccaacaagggctaagggccctttttaaagattgttttactgcgttatatttctacctcaactttagaataactccccccaaacgtaatcttatggtgagaaccggttgctttcttcgtaataagccccttttttaaatcctgggaaaccacggaaaccctacac

SEQ ID NO: 457999 - DNA, 2163 bp, Homo sapiens
  misc_feature (540)..(540): n is a, c, g, or t
ggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcntgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcataactgcctgcttgtgattctaatagctctttgttgtgtgtgtgcgtggggggtcgtgttgtggggttgtggcgtgtttgtttgtgtggggggg

SEQ ID NO: 458000 - DNA, 460 bp, Homo sapiens
tctctaatacgcccaggtgggatatcaattctgtcaccatgagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgcta

SEQ ID NO: 458001 - DNA, 303 bp, Homo sapiens
agattatctaagaagatttgaaagtataccagatatgcttgaattggatcacctcacagtttcaggagatgtgacatttggaaaaaatgtttcattaaaggtatgttgttacaatgaaaattatatttcttacagcttacaatataggtctcattttctagtcataaatttacatttactttaaggaatacttgttagtcttagtgccaccttaattactagtgtaattattttactgaaatgagaatctttaaaataggatcactattagcattagcttactaaagatgattgagtaaaagc

SEQ ID NO: 458002 - DNA, 2142 bp, Homo sapiens
  misc_feature (540)..(540): n is a, c, g, or t
ggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcntgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgcta

SEQ ID NO: 458003 - DNA, 2081 bp, Homo sapiens
  misc_feature (479)..(479): n is a, c, g, or t
gcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaaggtacctgtgcgtgcacgcagacgggaagggctggggaagcgggaggactgagaaaaccagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcntgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgcta

SEQ ID NO: 458004 - DNA, 720 bp, Homo sapiens
gagcgaggtgatctagaggatcccagaatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaatacttgtgtacactggtactttataatgcta

SEQ ID NO: 458005 - DNA, 2357 bp, Homo sapiens
  misc_feature (540)..(540): n is a, c, g, or t
  misc_feature (2187)..(2187): n is a, c, g, or t
ggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcntgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggataaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaaaaaaaaaaaaaaaaaactcgagactagttctctcctcgagttttttttttttttttttttttcaaactccagttctccaagtgacaaatggagagataaatgtgaaaatattttgtgaattcttttttcataancaatgatttatttatgtgtccatctatttgtttgcttatccttcttgaccttaaagaacttaaagatgttattaaaacaataatgtttatttttatagtcgtatgatgaggctatagaaattctaagtgctgttgtttttctgaaggaaattgtttgcattgcatttact

SEQ ID NO: 458006 - DNA, 731 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaaggtgttctagctgagcgtttaagagcatggactctggaaccagactttgaatccttgctctgccactgcagctgtgtgaccttgagcaagctatctaaatattctgtgcctttgttttgtcatctgtacaatggagatgatgatggtatcaccttcatggggttgtcataaggattatgggacttaacataataaagtgtttagaatgg

SEQ ID NO: 458007 - DNA, 1152 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggagagtagcgatttacgaagagcaaatggaagcgaaaaccccttttcttctttgggccggctgtgtattgctggggcacttgggcagacccccaaagacatccttaaagacaagagaaatcgggggctgtgtgaagatgtcacatctgcagatagggttcgaggtagagcggccttttgggttttctcctcatttggagaaatcgagaagtagcacggaagaccttcagacccagagcttgtgtacggcacagtccttgaaggatttgctcccattctcagggagcaagacccatcttaaacgtggaaacaaatacagcagagtaatacatacttgaggcttaatgtaagttaattcctcttggcacagccccagatatcttgattaaatggtctgcgaagtgctgagatatcttgataatgtacgttttacatttgattatataatcaattatgtttctcctaataaaatttaaaatgagctaaa

SEQ ID NO: 458008 - DNA, 485 bp, Homo sapiens
tagcaacagctgacagcagggcacccggccacaggagagaggtgacccagacccttaataaaaaaaccctcatgggagacaaattattgtgtgaaggaaaataactcaggctttcctcattgccaccctccgtgagattttaccccagacctgaggcggctgtactaacaggactctgatctttctctttgtgttcaaggatatcccaacttcgtggcgacctatggccgtggctaccccggatttgctccaagctatggctatcagttcccaggtgagtggcttggtctcccagggctttggaagcacaagaggtgggctgcatttgcggggaggtgagaggacccctaaagagaatgcatttcttacatgcatccacttgaaaatgacctatacatgataaatttcaaatccactgaagttcaaggccaggatgcagctcagagtttttgattaactcaggtataactcactggtgccgggta

SEQ ID NO: 458009 - DNA, 360 bp, Homo sapiens
tagaggatacccagatcgtgcgacatgagctggcagagctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagagttccttacaagacaatctgatttgatccgcaggagaatcctgtaaggtcaattatatagtcgctcttttatatatgacgcatgcagtaggctcagtatcttcc

SEQ ID NO: 458010 - DNA, 3521 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaa

SEQ ID NO: 458011 - DNA, 2625 bp, Homo sapiens
gccccccaaaataagtctccgtgcctggggaaaggcaccgttcgcttagaaggatcactgagaattgactggagaatgacttccacagaaagcaccctcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaa

SEQ ID NO: 458012 - DNA, 5401 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaatagtaaattcccagaaattcagtgtttagacgagggaatttaattcctattttgtccatgttggtgatgtactgtacttcccttccttttctctgcatcccccatcacctcatagaagactctttgttgatcattgtatgttaataatgtataaaatggctatcttgtaagcgtgctgtcctggtactagtgtagcgactttttttctcctctttcttctagtacatattgataggtataacataattaaggtttaaaaaaaattagacatagttattcagatttaggaccagtaaggatagaactttctcttatttatgaaaaaaaaatgctaataattttggggcagttttttcctttaattatttttttcaatttcaagtttaattttattttagctgatctgatgtggtttcaactaacccaaggtctcaccatgttaaaatgccggcggactctacggcgttttgtagatcccccccccccacccactgtgaaggggtgccatactaccttaaatgctaatgctagatatgcaaaactggatttttttaatttattttttaaaagagggaggcatggtatattaaaatgattttactaagagaaaaaatatttttttaagaatgctcagaagaaattgataatctgtgtgaatatgttttagatgtttatataccttttgaagagacccagtagcccatagcacaaatcttgtggaaatccgatatgttttaatgtggctacctaggtttaaggttcacgttagtccccccattccatctagaagtccattttgaaagatttttgtaaattcttttaacactgatgtttcagcctcgtctttgtttcagttaagctcaatggcgaacatgggaaccacctttcgccttccctgggggagaaaccctcttggctgatggcttttccccggaattatcaaacagccaccgggtgactttctggcttccagatccatctgcctgagacccccgaactcctctcctcccaagcagaggcgagtgagtggcattagctcccggacccattcccggtcctagctgggcatggggctgacggagatgaccaagccttggtctgctctctagcagcttccacagacttggctcgtggccttccttatatccactgggaacaaacagcctcgcgctctataccaaacagcctcgcgctctatcccagtcgcccattagcttgattcaaacaaagccccagcaggcctttgcgtttttatccttcataaccttcatcttaatttgaacttgtagcttggactttaaggtagcatggctctattgctgtcaatttactgtttcactgcacagcaatcacagccagtgaatgttacacacatcttgctagactagtataaaaatcattgggtaattgttggttctaatgacctgaaaggtgttcagtttttgttcttggttttgttttgtttttgatttcttgggggtgggttttgcttgttgttccttttcatttgggggtttttggggaaaaaatttatttttggttccaaatagaaaaacaaaacctattttgatctttagtgcaaacgagggctagggacttagcctcctccaccacctccacactgcttcattctgccattcactcactgcagcatattcaagaataaagcaatatcgtttactacattttttattgaaggtcagccatgctttctgtattatattgcatatgaaattgtttacaaaaaacactaactcatacttctctttattggttgcaagtggcacgcaggaacagagggaggtggggggctggtgggggagggg

SEQ ID NO: 458013 - DNA, 3351 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaacctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaa

SEQ ID NO: 458014 - DNA, 3447 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacaaccagattaaatgctgagcgcttttaaaatatcaaaacttgttcaagtcataaaacaacaaaacataagttttatttaaaaaaaaaaaaagaaagaaaaaa

SEQ ID NO: 458015 - DNA, 2851 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatca

SEQ ID NO: 458016 - DNA, 2701 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatca

SEQ ID NO: 458017 - DNA, 978 bp, Homo sapiens
tagaggatacccagatcgtgcgacatgagctggcagagctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaaggtaagtaggagaataaacagtaggattttagcactcagagatgattgccaagaatttcaaatttcaaacagcattggccatgaactgttgaagcctggtattcactgttccttcggggtatcaggacaggctgggcaagtagtcctgtgagataaccatgcgtctctaagttagccatcccaaggtggcttctgaacatccacctgggggcagggacaagtctgatgcttagtgggaggacgtgtttccatcgactgcagtattttttgcaaggattctatttgttttttaagcatttccaatatcatatcaggaaaagtcgaacatttccttgtgactctttcggagggtactctttgaggctttacaacttggagttaatgcagaggagtagagtttgactaaacagctgatcctttcttggaaaagacaacttcttaggcccataaagccttaaatctgggagggcaagcagtggatatcttggttttaggttggttggataagtcagggcatacttgaaaccaacagtgcttcttatttgtgcaagtgctggtgcctgaaaaaaatgtatattctgttgatttgggatggagagttctgtagatgtctattagctccacttggtgcagagctgagcttcaattcctgggtatccttgttaactttctgtctcaattgatcatgtcataatgttgatcagtggggtgtctttcacatggt

SEQ ID NO: 458018 - DNA, 1141 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaaggtgttctagctgagcgtttaagagcatggactctggaaccagactttgaatccttgctctgccactgcagctgtgtgaccttgagcaagctatctaaatattctgtgcctttgttttgtcatctgtacaatggagatgatgatggtatcaccttcatggggttgtcataaggattatgggacttaacataataaagtgtttagaatggtgtctgcaacataaggaagtgtatgggtgtgtgagttgtggggttgttagaaaggagcacgtcctgtggcaggtttgggtaagtgctccgtgcctgccttacgtagtagttggagaacgctaagtactgctgtcttctgccttacgtatttttccttaagtaatgtttgagaaatacaaaagaagacacacacacgtggttgtgcgtttatgcatataaatgtatgtgacacgggtagaattgcagtgtaatttggattcagacaaattcatgtgccataacgaagtgtgtggtttgttggcagcacgggctttggactcagagggacctagtttgaaacttgataactgccactaactctgtgactttaggaaggtgttccagcctttctgggtttcaattctgtactt

SEQ ID NO: 458019 - DNA, 211 bp, Homo sapiens
agataggcttggtaggggcggagggagtggggactagggatttggagctgaggaggatgtcatcctggcccctcatggcacggtgtctcagaattacatattcatgctggcaaccacagaactagtcctagagataatttcctttcccagaatatgacaatctgttcccatgtatagcacactgatgaccttaacaattgtgcaattttag

SEQ ID NO: 458020 - DNA, 538 bp, Homo sapiens
cgttcacaatagagaaatcatgaaaccagcttgtgaatgacgtgatgccacataggccggggcctgagaatatgggaaaacaaaactgcaaatagaggctggatcctactcaccccccatcaccctgcattttacacattgaagtaaaatgttatttttactgtcgttatttttattactttctctccaggtgttctagctgagcgtttaagagcatggactctggaaccagactttgaatccttgctctgccactgcagctgtgtgaccttgagcaagctatctaaatattctgtgcctttgttttgtcatctgtacaatggagatgatgatggtatcaccttcatggggttgtcataaggattatgggacttaacataataaagtgtttagaatggtgtctgcaacataaggaagtgtatgggtgtgtgagttgtggggttgttagaaaggagcacgtcctgtggcaggtttgggtaagtgctccgtgcctgccttacgtagtagttggagaacgctaagtactgctgtcttctgc

SEQ ID NO: 458021 - DNA, 456 bp, Homo sapiens
ccatctctctctttctctctctacagatagccttagagactattttagcaaatttggagaaattagagaatgtatggtcatgagagatcccactacgaaacgctccaggtaaaccattcccttctggattttgtctttattttagaacaaagtttaagttttatttttggaggtgtcttcggaagtagctaagcggattagaatggggctcaggcgcgtggctgatctcgaacggcgctctataccacccccaccgccccctagtaaccccagaggttattgttaattggagctgaactctggatacagagatacccatctctctgcttttaagtcattttcccgtcgcttctttttctctgtttaaaatgacattcagcttcatttactttcgcatagtttttttttttcttttgatcttaatgtgtgtttcccccacactcccagctccccaaa

SEQ ID NO: 458022 - DNA, 524 bp, Homo sapiens
ctccattttatgttttcttctggacatcctggccttccctgccctgcagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctcccta

SEQ ID NO: 458023 - DNA, 721 bp, Homo sapiens
cgatcctgtgtttgtgctcccgaaggacttggcgacttggctaacaaggagacatttgttatttcatttcctcatccattattcatgcagtgagagatggtcacaagaacaaagaaaatatttgtaggcgggttatctgcgaacacagtagtggaagatgtaaagcaatatttcgagcagtttggcaagctggcacagcatgacacatgcatgcatgcttctgactaacacactcacccacactagcagcatcagtacgggcttctgcgcttctgatcaactttcttgcaccaatgcaagcatgttgtggcagcacaagctctgtgcagcattccatttcccatgcacacatcacataataccaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactagctcttaagagaggcatagcaaagtgggggttgctaccatttctagagagagaggacacagtcccggcctgggctgcccccgctccagtcaatgctcactgaaagtctgtcttagctgcctgtt

SEQ ID NO: 458024 - DNA, 3575 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaa

SEQ ID NO: 458025 - DNA, 3225 bp, Homo sapiens
  misc_feature (80)..(81): n is a, c, g, or t
  misc_feature (83)..(83): n is a, c, g, or t
  misc_feature (87)..(88): n is a, c, g, or t
  misc_feature (96)..(96): n is a, c, g, or t
  misc_feature (98)..(98): n is a, c, g, or t
ggcagaattgcttgaacccgggagacagatgttgcagtgagctgagatcgtgccactgcactccagactgggtgacagannangtcnncgtctcanangaaaaaaaaaaaagaacacagcacggagaagatgcccagagcccttcactgtgggcccatgagatgacacagatctttccactaggccatcctgttttgttgctggagaactttgtccctggaagggcagaaatgattattctggttgcccaaggcctggtggcccaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaa

SEQ ID NO: 458026 - DNA, 5290 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaatagtaaattcccagaaattcagtgtttagacgagggaatttaattcctattttgtccatgttggtgatgtactgtacttcccttccttttctctgcatcccccatcacctcatagaagactctttgttgatcattgtatgttaataatgtataaaatggctatcttgtaagcgtgctgtcctggtactagtgtagcgactttttttctcctctttcttctagtacatattgataggtataacataattaaggtttaaaaaaaattagacatagttattcagatttaggaccagtaaggatagaactttctcttatttatgaaaaaaaaatgctaataattttggggcagttttttcctttaattatttttttcaatttcaagtttaattttattttagctgatctgatgtggtttcaactaacccaaggtctcaccatgttaaaatgccggcggactctacggcgttttgtagatcccccccccccacccactgtgaaggggtgccatactaccttaaatgctaatgctagatatgcaaaactggatttttttaatttattttttaaaagagggaggcatggtatattaaaatgattttactaagagaaaaaatatttttttaagaatgctcagaagaaattgataatctgtgtgaatatgttttagatgtttatataccttttgaagagacccagtagcccatagcacaaatcttgtggaaatccgatatgttttaatgtggctacctaggtttaaggttcacgttagtccccccattccatctagaagtccattttgaaagatttttgtaaattcttttaacactgatgtttcagcctcgtctttgtttcagttaagctcaatggcgaacatgggaaccacctttcgccttccctgggggagaaaccctcttggctgatggcttttccccggaattatcaaacagccaccgggtgactttctggcttccagatccatctgcctgagacccccgaactcctctcctcccaagcagaggcgagtgagtggcattagctcccggacccattcccggtcctagctgggcatggggctgacggagatgaccaagctcgcccattagcttgattcaaacaaagccccagcaggcctttgcgtttttatccttcataaccttcatcttaatttgaacttgtagcttggactttaaggtagcatggctctattgctgtcaatttactgtttcactgcacagcaatcacagccagtgaatgttacacacatcttgctagactagtataaaaatcattgggtaattgttggttctaatgacctgaaaggtgttcagtttttgttcttggttttgttttgtttttgatttcttgggggtgggttttgcttgttgttccttttcatttgggggtttttggggaaaaaatttatttttggttccaaatagaaaaacaaaacctattttgatctttagtgcaaacgagggctagggacttagcctcctccaccacctccacactgcttcattctgccattcactcactgcagcatattcaagaataaagcaatatcgtttactacattttttattgaaggtcagccatgctttctgtattatattgcatatgaaattgtttacaaaaaacactaactcatacttctctttattggttgcaagtggcacgcaggaacagagggaggtggggggctggtgggggagggg

SEQ ID NO: 458027 - DNA, 4241 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaaaaaaaaaaaaaaaaaaaaaaaaaaaaaagaaacaaaaaaaaaacaaaaaaacaaaagagagaggggcgcgaggcgcagcgaaaaaacccctcacacgcgagggcgcgcgccccacttcgccgcacaagaagacaattgtgacaaaagaaaggagcacacacagagagagaagccacgcagaataatgataaaaaacagaaagaacagagcacgaaggccagtcacaaacaaaacacaacacacagaacaggaacaggagcgaagaaacaaaccaagagaaaagaggacacacactaataaagacgaaaaacacaccacacacacacgtaggtgaaaagagagcaaacaaaaatagaagcaaaacacacacaccaaacacgacaaagaaaaaaaacaaaaagcaaaaacaaaacgaaaacaacacaaaaaaaaacaaaaacaagagacaaaaagagagtggaaaaccacaaacaaacagaagcgaaaagaatataggacgcgaaacgccgaatggcgaaaaaagacaatacgtgacgcagcaaaacgagaaagtaaaaagcacagagcaaaaaacatccatcaaaccacacacgagcgaaaagaacaaaacaaaaccaacccaacccaacgagaacaaaaagaagaaaaaaaaagccagagaacaaa

SEQ ID NO: 458028 - DNA, 3307 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacattttttttttgcttgttttggttctgttctcacttttaaaggatgctgagatggtaatatgactctccctattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactgtagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactca

SEQ ID NO: 458029 - DNA, 1518 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggtgagtctggacaggaccgcaggtcaccatggactgggagggctatggaggcctctactcccaactgggtcacctaccagtggggcaaactgcttcacctttctaagcctcagtttccttgtctgtagatgaggatgataattccccgttccaagacagttgtgatgattaagtgtgggtgtgtgtgtgtgcatgcatgtgtgtgtgtgtgtgtgtgtgtttgtatttataatattgccccatgcctggcttataggatatgttagactattttctctcttttccatctccttcctcaaaagaaggaaaagtccccctctatctgcctcagccctctcatctgagtgggagttcttaagatgtaaggactcctggctgacttgacttgtgtgggctaaggctacgttttctaaaacttgggagaggagggaagtggtaagggtgggcgataatcctgtctatttaaatgattaacatttttctcttgggatatcaaaatttgcatttaaatggatgttttaaatagcctgttttactctttatttgccaaaaaaaaaaaaaagatgaaagacaaagtgtgtttgttctgactaaaaatgatttctcctggcttttagagaaattgagttgcatattatgtccctttccttaaaag

SEQ ID NO: 458030 - DNA, 1033 bp, Homo sapiens
cggggctgagctaagccgagcccacgtgtgaacggctctcccccccgccccggccccgccgctcgcagagagattcggaggagcccgggcgggggggaggaggagggggaggagggagcggagatctcggggctcggagccggccgccgctccgctccgatcgctgtggggcttggttttttgggggtgggggggcggggtgggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaaggtgttctagctgagcgtttaagagcatggactctggaaccagactttgaatccttgctctgccactgcagctgtgtgaccttgagcaagctatctaaatattctgtgcctttgttttgtcatctgtacaatggagatgatgatggtatcaccttcatggggttgtcataaggattatgggacttaacataataaagtgtttagaatggaaaaaaaagaaaaaaaaaaaaaggggaagaaaaaaaagaaaattttaaaaaaaaaagtcaagccgcacacaacgctcgtggtcgggccgacgcgagcaccccaggagaaaggtctccacaaccaacgtcggggcggggggcggccccgagtgtgatcaccaaccgtgccacagcggctccagagaaaacacgcgcggcgacaaaggggggggctccccacaaaaacccgcggcgaacccgcgtggtgcaaccaccgcagagtgcgggcgcaggcatccagagggccaggacggatataccag

SEQ ID NO: 458031 - DNA, 1466 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458032 - DNA, 1757 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaa

SEQ ID NO: 458033 - DNA, 1929 bp, Homo sapiens
  misc_feature (1532)..(1532): n is a, c, g, or t
  misc_feature (1563)..(1563): n is a, c, g, or t
  misc_feature (1573)..(1573): n is a, c, g, or t
  misc_feature (1583)..(1583): n is a, c, g, or t
  misc_feature (1585)..(1585): n is a, c, g, or t
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaanttggggcaanttaaaccaancnaccttaattttagcaaattttttcatttcgcccttttttggggctttttggaccaaatggcccttatttggggagcttttaaattgtggaacccttggtttaccccatttgaacaggggaaaaacagggggggcctcaaataaaatgggtgaggagacaaaaacacctttcccggtggggggtctccaggggggggcccccctaagtgcgtttttcaaaacgttggtggaaatttttgggaaaattgaaaagaaacccccaattatttcgttaaattcgggaaaatttttggaaaaagagaaattttttcccaaaaaccgatggccaaaacccctttatttaaa

SEQ ID NO: 458034 - DNA, 1475 bp, Homo sapiens
  misc_feature (1428)..(1428): n is a, c, g, or t
  misc_feature (1441)..(1441): n is a, c, g, or t
  misc_feature (1457)..(1457): n is a, c, g, or t
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtcaaggtgggttcatntttgcattctganagcactggatgggtgncttccgctttttggtctt

SEQ ID NO: 458035 - DNA, 1395 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458036 - DNA, 1322 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458037 - DNA, 851 bp, Homo sapiens
aacaaggataccggtttgagcattattagcggcatctctgttcgagagttttatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458038 - DNA, 1341 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaagggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458039 - DNA, 1564 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaa

SEQ ID NO: 458040 - DNA, 742 bp, Homo sapiens
  misc_feature (9)..(9): n is a, c, g, or t
taggggggnggggggaggcggggagcacgactcatcttataactaatgtgacacacctccctagacagaaccgctttttcaattctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458041 - DNA, 1370 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458042 - DNA, 1968 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaaaaaacacaacaaagaatagaaacaaaaaaaaagggggggggctaaaaataaccccgagggcccagttagtgcccccgttttgccaacgggcctaagggacgtaaaaacaagacgggccggtaaaagccggcgggaaacgccggtccggggagaccctccggcgggcatggcacccccggataaaggcggataaatcggcagggcaccgttc

SEQ ID NO: 458043 - DNA, 1730 bp, Homo sapiens
  misc_feature (1730)..(1730): n is a, c, g, or t
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatcttctatccgggtaacaccaaagcaattctctcctcaaatcctggcctaaattcagtcggttcactcacattacggcgccaaaacaaacaatgcagctccaatcgtgtgtgcgtcagggttccaccgaacttcagggtttgcccctgggggacagaacataacaccgaatatcgagcgcggcaggggacagcagcaatctcctcgaaacggactcgtaatattttctaaacaggaccgaaccaaacaccagtccctgcgaaccgcacaaaccacacacacaaagcccgcatcacacacacacgcgacactcgccaacgaccaacgcccgcggacacacgcgcgcagacgtccacacagaacacctgccn

SEQ ID NO: 458044 - DNA, 1400 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458045 - DNA, 1408 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458046 - DNA, 1182 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 458047 - DNA, 725 bp, Homo sapiens
gtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaaagaagatgacaagggtgattgacggcaagcaaaaccaagactggtggcccgcgacggtc

SEQ ID NO: 458048 - DNA, 2911 bp, Homo sapiens
cccgtgcaggggccctacggacaccaccagggctacgacccagagcagggccaggatggcggccgccttgcgctcggtcatgatggctgggtacttgagtgagtggcgcacgcccacgtaccggtccacggagatggtgcagaggctgaggatggaggccgtgcagcacagcacgtccacggcggccgtcgggggactggtggtgagcgcgcagggcgtgggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcaggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaagtctgtcaagaactaaaggcccgcaacagaatagattgggtctacatttgcctttctagtttcaacttaactgactctttaactgatggctgctgtctgttgggagttttagcatgaccaaaggacctgggggggggttgttaggttttaaaactcacatgatcggtcttgtgaaccaaatagtgatcctaagcacaaattgtccctttgtcagtctccccagatgcttatgtaatgctctgagggcctcagtgaggaaggcggccatcaggtaaatgggtgaaacataagtttacatgaaaagatatacaagcccgagtagatagctgtacatggctaggaaaagaacccatacctaggaaccatgcttgttagctttgagtaaaatgtcatattcctacttgtcatattcccatgagatt

SEQ ID NO: 458049 - DNA, 2420 bp, Homo sapiens
gcccttcagagaggttatatcagactgctccagcacagtagtttaatctactgtttatatataggtagcgcgggttccatatgtacaaaattttattgaacttgctcagcaattctattaaagcagaattatactgagttttgggtgtaagagtatatctgttcatagcagcataattactagcctggtcagacgttatcttctgtgtaggaagaggcaaggactagggtcatttatcatttcaggaaaacagtgactcagacaggagatgtggcagggaggcgggggcatatgttttatcctattttatcttcaaagcatctttccagagagccgtactttgtcacagagtcggggactttgtgaaattatgctggcacgcagaaatgagcaaacatggctatgtttgctactttgtctcataatacgaaactgccaatattgcaccggttttgagctacaaaaacagcaattgcacgtggttttgtctaactctactctggtttgttgcctacattcattgaaggtaatcctcaatatcaggtagaggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaagtctgtcaagaactaaaggcccgcaacagaatagattgggtctacatttgcctttctagtttcaacttaactgactctttaactgatggctgctgtctgttgggagttttagcatgaccaaaggacctgggggggggttgttaggttttaaaactcacatgatcggtcttgtgaaccaaatagtgatcctaagcacaaattgtccctttgtcagtctccccagatgcttatgtaatgctctgagggcctcagtgaggaaggcggccatcaggtaaatgggtgaaacataagtttacatgaaaagatatacaagcccgagtagatagctgtacatggctaggaaaagaacccatacctaggaaccatgcttgttagctttgagtaaaatgtcatattcctacttgtcatattcccatgagatt

SEQ ID NO: 458050 - DNA, 3041 bp, Homo sapiens
ctccctgccggccgctcgttctgtgcccccggcccggccaccgacggccgcgcgttgagatgactttccgcgatctcctgagcgtcagtttcgagggaccccgcccggacagcagcgcagggggctccagcgcgggcggcggcgggggcagcgcgggcggcgcggccccctcggagggcccggcggtgggcggcgtgccggggggcgcgggcggcggcggcggcgtggtgggcgcaggcagcggcgaggacaaccggagctccgcgggggagccggggagcgcgggcgcgggcggcgacgtgaatggcacggcggccgtcgggggactggtggtgagcgcgcagggcgtgggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcaggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaagtctgtcaagaactaaaggcccgcaacagaatagattgggtctacatttgcctttctagtttcaacttaactgactctttaactgatggctgctgtctgttgggagttttagcatgaccaaaggacctgggggggggttgttaggttttaaaactcacatgatcggtcttgtgaaccaaatagtgatcctaagcacaaattgtccctttgtcagtctccccagatgcttatgtaatgctctgagggcctcagtgaggaaggcggccatcaggtaaatgggtgaaacataagtttacatgaaaagatatacaagcccgagtagatagctgtacatggctaggaaaagaacccatacctaggaaccatgcttgttagctttgagtaaaatgtcatattcctacttgtcatattcccatgagatt

SEQ ID NO: 458051 - DNA, 2609 bp, Homo sapiens
gcccttcagagaggttatatcagactgctccagcacagtagtttaatctactgtttatatataggtagcgcgggttccatatgtacaaaattttattgaacttgctcagcaattctattaaagcagaattatactgagttttgggtgtaagagtatatctgttcatagcagcataattactagcctggtcagacgttatcttctgtgtaggaagaggcaaggactagggtcatttatcatttcaggaaaacagtgactcagacaggagatgtggcagggaggcgggggcatatgttttatcctattttatcttcaaagcatctttccagagagccgtactttgtcacagagtcggggactttgtgaaattatgctggcacgcagaaatgagcaaacatggctatgtttgctactttgtctcataatacgaaactgccaatattgcaccggttttgagctacaaaaacagcaattgcacgtggttttgtctaactctactctggtttgttgcctacattcattgaaggtaatcctcaatatcaggtagaggtgagtgaaaacaattattatttttctctatccaagttcatggacctcctgatttacagcacggatcccttgagaactcctagtcaatgactcagccaaggctactgaagggtctcccctttgcgcccagagccgcctggcctccccctccccaagcagctaaacagtatcggtctctgctccctacaggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaagtctgtcaagaactaaaggcccgcaacagaatagattgggtctacatttgcctttctagtttcaacttaactgactctttaactgatggctgctgtctgttgggagttttagcatgaccaaaggacctgggggggggttgttaggttttaaaactcacatgatcggtcttgtgaaccaaatagtgatcctaagcacaaattgtccctttgtcagtctccccagatgcttatgtaatgctctgagggcctcagtgaggaaggcggccatcaggtaaatgggtgaaacataagtttacatgaaaagatatacaagcccgagtagatagctgtacatggctaggaaaagaacccatacctaggaaccatgcttgttagctttgagtaaaatgtcatattcctacttgtcatattcccatgagatt

SEQ ID NO: 458052 - DNA, 2782 bp, Homo sapiens
tcaacgcaccgcgcgcccaagggcaccagcgagtgaccgagagactcgggggagagggcgggaggaagagggacgccgctgagggccaaggggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcaggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaagtctgtcaagaactaaaggcccgcaacagaatagattgggtctacatttgcctttctagtttcaacttaactgactctttaactgatggctgctgtctgttgggagttttagcatgaccaaaggacctgggggggggttgttaggttttaaaactcacatgatcggtcttgtgaaccaaatagtgatcctaagcacaaattgtccctttgtcagtctccccagatgcttatgtaatgctctgagggcctcagtgaggaaggcggccatcaggtaaatgggtgaaacataagtttacatgaaaagatatacaagcccgagtagatagctgtacatggctaggaaaagaacccatacctaggaaccatgcttgttagctttgagtaaaatgtcatattcctacttgtcatattcccatgagatt

SEQ ID NO: 458053 - DNA, 1457 bp, Homo sapiens
aaacttttcatattgaacttttatttctgtgcggtagtcagttaaattcttcatggcatatagtaattatcaggccatttgagaatattttacaagcaggttggaacagagaacaggtagtaggaaaccaaatcttatctctttgagactcattttgaattaactacccctcacctctcattcgaaggcactatattttgcagagaaaaactcacacaacccaaatgtttaatcagaagccatgtaataactgaaacacatgttcagtttctcaataatgcttatttctaaagagaacattaaaaacttggtggcgccggggtggggcttaaaaccattgaatcactggtccccaacttttttggcaccaaggaccagtttcctggaagacaatttttccagactcgggggtggggatggtttcaggatgaaactgttccagctcagatcaggcattagattccataaggagtgcacaacctagatcccttgcatgcacagttcccaataggattcgtgctcctatgagaatctaatgtcaccactgatctgacagaaggtggagctcaggcaataatacttgcctgcccacccagttcctaactggtccgtaggcctgggggcacctgcatttactgacctaatttcagtatttaactccctactattcaaaaattttctggaagttactgtagcttttcgggcattacgtaagagtaactttccctacctctctctaggttgggaaagagaacaaaacaatgagaaaagttcactgccacaatatcagacagctgtcttttctgttttggtttgtgtggtttcctgcagtactgaggacacaaatttctcaagtactctgcttcagggcattttgcataatgacattttatcacaagagaaaggaacaaaatctcttgaaatgaaatttccataaatggctatttgaacagtttctaaaaagaatcatttgcattccaaccccacaccccatttctcttctcctcactcacttcttgcatatgctacaatctcacctttccttcctgtatcttttgtttaatctttttcctctgatttccttataagcaagtcttcacaaatcctaatttagtcaagatccaaagagcctccacttcttcaatatgggcttctctaatgtctaatctacttttgaaaaatctgcgcttctctatgtaatttgcaatacaattatgctacaacttttctatagaaaagtaataatcaggagaatgaggacttagccctaaggatttgctgcaactccagaattttttgaaatgttctttaaaatcatgtcaattttgcattcaattccactgtttgaagataaaattttaaattacttaccagtgaatatccttggtggcccttaatccagaatgcatgccatgattacactattgctcttaaatgtaattactgacactaacatt

SEQ ID NO: 458054 - DNA, 5848 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458055 - DNA, 719 bp, Homo sapiens
tcctgcagctctccctgagtggtatggcaggcacagctcaagcgtagactttcagccgctcgcgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaagtgcacagatgtaaagtctcctccagatatgatacaggtagctctggcagaagcaggaagcatggcagacagcaggaatcaggttttga

SEQ ID NO: 458056 - DNA, 1548 bp, Homo sapiens
gtttgagaggtgaggacccaggtgactcgggggtaacttttagctttctggaagatgactaaattttaccaaatgataatggaaatgtattcctaaaatctaaacaacataaactcttaaggtactaagttatttaagttatttgtaagttatctaagttcttcctaatctcagaaatcgattaatgtagtggttttcccaagcctttctcattatttctcttgggtgtcactggcattgacttccactaaaaaaagatcccatggtcaaatgactttggcatacatacaactggataaaaacaatataaaacagtttttcctgcagaactcttctgagtctgtaatatgctgacacttgtttttaatcttcaagataaggatacagaacttttcatcatgggatagttttttcaaggaacacatcatagaacgtatggtctacggatcaccattaaagttatccatggtttgcctaaacagcttcctgattcattacgagaatattccccaaacaagaaaaatgaaacatactttaagtacctggaaaggatctgttttttgaaaagcatacacccaagttttacttttgaaatcctaaggtcttggttttgaaaaccccaggcgctaaggaaattacatgttttaaaatcctaaaggttgaggaattaatattctaaacttcaaatttttgaataatcatgacgttattggcaaatacatataaataaacatataaccggaacacgtttttcccctttatccaatggaaatacgatcaagcatcactcttagcagaagactaccagacacttgtagggacacgaaaagtgataataaaaacaatttatttattgaatgcttgctatagaccagatgctcttctaagcactttgtaattattttatcttgaaagcagtcctgtatttataatcattacctcttcttacagatgtggaagacgtgactcagtttcctgattacccagggtcacataacatgtgtggagaaggcaggatttaccacctcagtccgcagttcatgctcttaaccataatgctgtactcctcaaacctgccactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagaggaaggccgggcgcggtggctcacgcctgtaatcccagcacttcgggaggccaaggtgggcggatcacaaggtgaagagatggagaccatgctggccaacatggtgaaaccccgtctctactaaaaatacaaaaattagctgggcatggtggtgcatgcctgtagtcccagctatttaggaggcagaggcagaatagcttgaacccgggaagtggaggttgcagtgagccgagatcatgccactgcactccagcctgggagacagagtgag

SEQ ID NO: 458057 - DNA, 811 bp, Homo sapiens
gatagccatcttacttttctgactccagggttataaatacatccagctgtatgacaaaaactctatactaagcaattgagcatttattcttctaaagtgacacacactttttaagtatttatgtgggcacctgagaaaaagactcaggactattttataggccaggagttaaaaaacaacttgaaaaattttaaatgctagttctatttatatcagaatactgtttaggaatctctatactgaatacttgcagtctgtaagatacaatactttgttgaatgggagaaagttgtttcccagacatatgattccaagtacatagtttttcaacatcatttttgagccatttccaatattctggtctcctttagaaagaatgaaagtcttccctgggtaatttattcttcatatttaggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccgtaagaaattttttcattttacttttagacatttgtttctgtgtgattctctgtttacattttagataaaatccatttctgtcagggtactaagtgacatttccaaataagaaaaacgtccgtatattaaatgtttccacttcttaaacttatatatgtgtatcaaataactttctccaatgttacgcagatacagacacacctgatgggatactcaggtagccaatcaaaagtcaaatatttacattgaa

SEQ ID NO: 458058 - DNA, 4580 bp, Homo sapiens
gggaggccatgagccacgcctgctgactcattcctccaattctcaaacacaagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458059 - DNA, 3638 bp, Homo sapiens
  misc_feature (21)..(21): n is a, c, g, or t
  misc_feature (54)..(54): n is a, c, g, or t
cgacccatcgcagacgatggnggcgtacacccgccgggccagggacttcttggncagcaggacggccaccacaccctccgagcggcagtacccattccccgctgtgtcgaaggccttgcaggtgccctcggggctgagcatccccagcctcaaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458060 - DNA, 5930 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatatattgtatatattttggtgtacttgttactttcactgattgttgatgaatcccttttttcactgtaaacgtggatttataaaca

SEQ ID NO: 458061 - DNA, 6859 bp, Homo sapiens
  misc_feature (5886)..(5886): n is a, c, g, or t
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatatacaaaaaaaaaaaaaaaacacaaacaaacaaaaaaaaanaaaaaaaaaaaaaggggggggggcccgcaaaatcccccggggggggcgccacaagcagaccagaccaccacaatttattgaaaaaaaggagagcgccaaaaagagagacgacctaatatataaaaacgacggagaggagacgaggaacaaaacaaagacgaaagacaggagaaaaagaagacaagaagagaggcgacatccgagagaagaagaaaacaaacaaaagggggggaggagggaaaaaaacatatcgagccaaacaacaaccaaaagagagaaataataagaccacaacgacagagacaaaaacaaaacaaaacaacacggagcaaacacagaaggtgaaacaaaaaacacagaaacaataaacgaagacgccgaagaaaagaaaagagcaagagcaccagcaccaggcgcgagatcaaccgatcaaacagcacacaacaaccactatccaccaccagcgggggcgggcctaataaccgaacaagacacaagcaacacgaccgaacaacacaccacgccacaaccccacgccgcaaaaacacaacagaccacaacaacacgaccacaccggaccacgacaaaacaaaaaacaaacagcaaagaaaaagggaagacgagaaggagaggggaaagagaaggaacaggaacgagagagcaaaagagaaaacagggaaagcaagaggaagacaaaaagagagaagagaaagatagaaaacacagacaaaaagggaaaaggaaagaagacgaaaaagagaaaaggaagagcgccacagcgaccacacgaggaggcagcgggaggagaaacgacgacaagagacagaggagaaagaaaaaaccaaaacaaagaccggccaacacggccaaagcggcgaaaaaaggaagaagcagaaggagaacaagaggaaacagaagagaggagaggcgggaagaacggccgagaagaagaaagacgggaggaaggaaacgc

SEQ ID NO: 458062 - DNA, 2807 bp, Homo sapiens
cagacacccccaagttagattatacttagttgaaagcctttaaactggatacttagaattcctttgggttttgttttgttttgatcatgtttattgcatttcatcaagtatgttttgttgtgagatagagtcaggtacgtaaagagcttctcatttgtgatgtatccgatgccaggtggcacattatcaggatgtaacctggattgtttgtacagacatggtctgtggggaaatcctaagtaagggggaggcaaaggcaggacggaggtgaagagtatagactccggagttgcaaagaactgaatcagaattctggcgtggccttttccttgcagtgagacttggggcatgttacataatctctctgatctctgagttcccacatctgtgaaatagtgattattataacacgtatcccatagggttattgtgagagttaaatgggatcattcatataaaacatttctgtttaaagtattattactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgattaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458063 - DNA, 5609 bp, Homo sapiens
  misc_feature (5400)..(5400): n is a, c, g, or t
  misc_feature (5404)..(5405): n is a, c, g, or t
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagncttnncatggtgcactgtctggcacagtttacacctcgacaatttttgccccaaacgtgagtcttgtgcccaggaaccgagcgctcaaatagagacaacttttctcaccatgagcgcaggccccataagagactcgccccccactaaaccccataaagaggagagacgcccagataccacagtgtattttcaggaagacgcgcgcacat

SEQ ID NO: 458064 - DNA, 5846 bp, Homo sapiens
  misc_feature (5321)..(5323): n is a, c, g, or t
  misc_feature (5338)..(5338): n is a, c, g, or t
  misc_feature (5355)..(5355): n is a, c, g, or t
  misc_feature (5357)..(5357): n is a, c, g, or t
  misc_feature (5376)..(5376): n is a, c, g, or t
  misc_feature (5401)..(5403): n is a, c, g, or t
  misc_feature (5415)..(5417): n is a, c, g, or t
  misc_feature (5427)..(5427): n is a, c, g, or t
  misc_feature (5437)..(5439): n is a, c, g, or t
  misc_feature (5447)..(5448): n is a, c, g, or t
  misc_feature (5464)..(5464): n is a, c, g, or t
  misc_feature (5468)..(5468): n is a, c, g, or t
  misc_feature (5485)..(5486): n is a, c, g, or t
  misc_feature (5490)..(5490): n is a, c, g, or t
  misc_feature (5500)..(5500): n is a, c, g, or t
  misc_feature (5508)..(5508): n is a, c, g, or t
  misc_feature (5519)..(5519): n is a, c, g, or t
  misc_feature (5526)..(5526): n is a, c, g, or t
  misc_feature (5532)..(5532): n is a, c, g, or t
  misc_feature (5545)..(5545): n is a, c, g, or t
  misc_feature (5553)..(5553): n is a, c, g, or t
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggggggcnnngggggggtccggggnggcggagtttattgggngngtggtatatactgtgaggnggagtgcggggggtgttgggggggnnntgggtggtgggnnngggggggggngggggggggnnncccatttnnttcccccccacactgnagantccgctgccccccgccnncccncccccctgcncccccctnccccccccccncttttcncccacncccatcgcccgcngccactgnccaaatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458065 - DNA, 2540 bp, Homo sapiens
cagacacccccaagttagattatacttagttgaaagcctttaaactggatacttagaattcctttgggttttgttttgttttgatcatgtttattgcatttcatcaagtatgttttgttgtgagatagagtcaggtacgtaaagagcttctcatttgtgatgtatccgatgccaggtggcacattatcaggatgtaacctggattgtttgtacagacatggtctgtggggaaatcctaagtaagggggaggcaaaggcaggacggaggtgaagagtatagactccggagttgcaaagaactgaatcagaattctggcgtggccttttccttgcagtgagacttggggcatgttacataatctctctgatctctgagttcccacatctgtgaaatagtgattattataacacgtatcccatagggttattgtgagagttaaatgggatcattcatataaaacatttctgtttaaagtattattactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgattaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaaaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458066 - DNA, 3700 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458067 - DNA, 1156 bp, Homo sapiens
gtgactctgcaggatcctttaagctctctctgatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458068 - DNA, 2253 bp, Homo sapiens
tgaaagggacttaatcaaaaaggatgtttattatctcacatcttaataagatatccagtagcaggatagcttcctgggtctgcgacccacatacttttcatctttctactctaccatcttaagcatatcagctttgtcctctagctcctcatggttacaaggtagctgccaaagttccagacatcatataaagattaataatggaagaagagaccacctattccttgcatctttttaaaaaggaggaagtcttccctagaagcctttaagcagtcatccttataaacctcactggccagcaataagtcacatgccaatgcataaatgtcactggaaaatggaaatgcgattacagtaattcacaaactaatatttaatgctgggttgataattttacctgacttagaggcaggtacctgaaaaaaaatcagtattctgttagcaagaaaaaaggcatggctaataaggagtcaacagtatttgctaaggatatcttaggtaatattttatggaagccatcattcaagtacatattttatttgaataaatcctctggggtccatttttatgttcaatagtttaaaacataagcaaagcttgaaagtaaatgaggatctgacgtatttgaagcttaacttcataaactttttttttcaccatcttccacattttacatttgaaactccttggctttgttgacaacccattattccggttctcctgcttctataattttctccctttctataatttcctgaatctagatcatttgtaggaaatatcaaatctccatatctgcattcacaagtttctgagctattcgtccaacctcaattaaaagatttcattgcctttaagtctcagctttaagctctggccctctatggttttccacaatgttcagattcactctgctatactttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaaacaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458069 - DNA, 2459 bp, Homo sapiens
tgaaagggacttaatcaaaaaggatgtttattatctcacatcttaataagatatccagtagcaggatagcttcctgggtctgcgacccacatacttttcatctttctactctaccatcttaagcatatcagctttgtcctctagctcctcatggttacaaggtagctgccaaagttccagacatcatataaagattaataatggaagaagagaccacctattccttgcatctttttaaaaaggaggaagtcttccctagaagcctttaagcagtcatccttataaacctcactggccagcaataagtcacatgccaatgcataaatgtcactggaaaatggaaatgcgattacagtaattcacaaactaatatttaatgctgggttgataattttacctgacttagaggcaggtacctgaaaaaaaatcagtattctgttagcaagaaaaaaggcatggctaataaggagtcaacagtatttgctaaggatatcttaggtaatattttatggaagccatcattcaagtacatattttatttgaataaatcctctggggtccatttttatgttcaatagtttaaaacataagcaaagcttgaaagtaaatgaggatctgacgtatttgaagcttaacttcataaactttttttttcaccatcttccacattttacatttgaaactccttggctttgttgacaacccattattccggttctcctgcttctataattttctccctttctataatttcctgaatctagatcatttgtaggaaatatcaaatctccatatctgcattcacaagtttctgagctattcgtccaacctcaattaaaagatttcattgcctttaagtctcagctttaagctctggccctctatggttttccacaatgttcagattcactctgctatactttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaaacaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaaggtatctaaagacatggcatctaaggggcttattttgtgtatctatcatggagtaaaaagtatctctttaaccaatgaaacttctaagaaggacctatgcgagtctctctgggtcatttcaggaaggctattctttaaagaaaagaacactgagagtacttttttcatgttcagcaacaatatactgtctcattattttttactcagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458070 - DNA, 1003 bp, Homo sapiens
atccattttcaatacttcattagcaactgcttcatgctgtccaaatcagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458071 - DNA, 5664 bp, Homo sapiens
  misc_feature (4641)..(4641): n is a, c, g, or t
  misc_feature (4691)..(4691): n is a, c, g, or t
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaaaaaaaaaaaaaaaaaaaaaaaaaaaaaaaaaaaaaaaaaaaaaaaaaaaaaaaaaaacaaaaanaaaaaaaaaaaacaaaaaaaaaaaaaaaacacaaacaaacaaaaaaaaanaaaaaaaaaaaaaggggggggggcccgcaaaatcccccggggggggcgccacaagcagaccagaccaccacaatttattgaaaaaaaggagagcgccaaaaagagagacgacctaatatataaaaacgacggagaggagacgaggaacaaaacaaagacgaaagacaggagaaaaagaagacaagaagagaggcgacatccgagagaagaagaaaacaaacaaaagggggggaggagggaaaaaaacatatcgagccaaacaacaaccaaaagagagaaataataagaccacaacgacagagacaaaaacaaaacaaaacaacacggagcaaacacagaaggtgaaacaaaaaacacagaaacaataaacgaagacgccgaagaaaagaaaagagcaagagcaccagcaccaggcgcgagatcaaccgatcaaacagcacacaacaaccactatccaccaccagcgggggcgggcctaataaccgaacaagacacaagcaacacgaccgaacaacacaccacgccacaaccccacgccgcaaaaacacaacagaccacaacaacacgaccacaccggaccacgacaaaacaaaaaacaaacagcaaagaaaaagggaagacgagaaggagaggggaaagagaaggaacaggaacgagagagcaaaagagaaaacagggaaagcaagaggaagacaaaaagagagaagagaaagatagaaaacacagacaaaaagggaaaaggaaagaagacgaaaaagagaaaaggaagagcgccacagcgaccacacgaggaggcagcgggaggagaaacgacgacaagagacagaggagaaagaaaaaaccaaaacaaagaccggccaacacggccaaagcggcgaaaaaaggaagaagcagaaggagaacaagaggaaacagaagagaggagaggcgggaagaacggccgagaagaagaaagacgggaggaaggaaacgc

SEQ ID NO: 458072 - DNA, 885 bp, Homo sapiens
tactgtcagaaaaaattttacatcaatctcagcttagatcatcagaagtactgaaagaatgaagtgaatatatgaaatgtagcaaagactaaagttagatacttcatgtaacttttcctgaaatattctttttagtaattacttcttttggtctagagcaaaatggcacagcagacttttaaatcttcctccaaacttgtactcatagtaattccatttcttaaactaatgtcttgctggaaaattgacatgcttttagattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458073 - DNA, 3851 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgaggtgagttgtgggcgttctcgcattgacttgatcagagagtggagggaactggggttctacaagagccttctgtaaattataaaacacagtacaaattaacgtgtctataagaacctgtatttaat

SEQ ID NO: 458074 - DNA, 1528 bp, Homo sapiens
  misc_feature (555)..(555): n is a, c, g, or t
agatgtttgccatactcgagctggagtaggtgctaatgggacaaaacatattcattgctcatgaaaactgtacttcataaatattttttcttgaattttaaaactttacagtaaatttaggacccgaagacaccaaatatagacactgcttggggaggaagcctagtatgatgaggttaactgtgggcaatttcatttcctaccctaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaaaaaaaaaaaaaaacaaaaaaaaaaaaaaaacacaaacaaacaaaaaaaaanaaaaaaaaaaaaaggggggggggcccgcaaaatcccccggggggggcgccacaagcagaccagaccaccacaatttattgaaaaaaaggagagcgccaaaaagagagacgacctaatatataaaaacgacggagaggagacgaggaacaaaacaaagacgaaagacaggagaaaaagaagacaagaagagaggcgacatccgagagaagaagaaaacaaacaaaagggggggaggagggaaaaaaacatatcgagccaaacaacaaccaaaagagagaaataataagaccacaacgacagagacaaaaacaaaacaaaacaacacggagcaaacacagaaggtgaaacaaaaaacacagaaacaataaacgaagacgccgaagaaaagaaaagagcaagagcaccagcaccaggcgcgagatcaaccgatcaaacagcacacaacaaccactatccaccaccagcgggggcgggcctaataaccgaacaagacacaagcaacacgaccgaacaacacaccacgccacaaccccacgccgcaaaaacacaacagaccacaacaacacgaccacaccggaccacgacaaaacaaaaaacaaacagcaaagaaaaagggaagacgagaaggagaggggaaagagaaggaacaggaacgagagagcaaaagagaaaacagggaaagcaagaggaagacaaaaagagagaagagaaagatagaaaacacagacaaaaagggaaaaggaaagaagacgaaaaagagaaaaggaagagcgccacagcgaccacacgaggaggcagcgggaggagaaacgacgacaagagacagaggagaaagaaaaaaccaaaacaaagaccggccaacacggccaaagcggcgaaaaaaggaagaagcagaaggagaacaagaggaaacagaagagaggagaggcgggaagaacggccgagaagaagaaagacgggaggaaggaaacgc

SEQ ID NO: 458075 - DNA, 1201 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctcctttcggagtccctgccttcccagcctctcctgcgctcatctctccattgtcttttctgtgcattttgctttcttccgaatggactgtcctctctccgcacccactcccccgcccccgcttgttcgtttttttcgggctccactccctgcttgtgtccccccaactctgttgcctgtccttcccgcagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggtgagggctgagagcggggttcgaggctctgctagcgcctcctcccgtccagacctaaggggcaggccctggggactccgcatccttccagcaatccagataggaagcgcagccagccggggagtcccgggattaggcttgtagctcaacctttcgccccatctcagtttgcacagttgcatccgccacacatttcctgccggcgcggtgagtatggaaaggcaggactgccgacagccctggctgccctgacccagagcctccaaaaggcctgattgtgtgtgtgttttttaaaactttagttttggaagtgtgcattaaaggtgatttatcctctttttaaaacccttgggtttccccacccccctctaccgcatcttcacttgggtaaagaggattccagcaatgacaggcgtcttgcaaggtgattccaatcactgaacgaacccgttttcctctcctcatttggtgctgttcccaactagatatc

SEQ ID NO: 458076 - DNA, 722 bp, Homo sapiens
gggaagatgtttcacttctggctaggcaaaggatgtctttcttgacagcagctagaggcactctgccagatgtcttgttccagtgagcagattcaatctgttgaactccagaatgatttgtggaaaactaaagaatcattcaacttgtgctttaccacctaaataagcccatgggattattatttagtttcagcttcagcttaaggtagaatgcgaggataatttctatggggaacataaaagtaatttaaaaaatagtctcaactattcacagatgtttctatttacagtttcatttattgttttattttttttaaatctcctgtaggtgtggaaaatgtaactatccaactggatttggaagcagaattccattttactcatctcataatgactttcaaggtaagaaatccatgactttctcacaaatgacacatgagagcactgtgtaatgtcccctttcaaaatggatgtcagatgtgagttgacctaaatgggaacttaaatattattgttgccataaattggggtaattgagcagtttttaaaacgagcatgaataactgcatttaacaaatactctatcttcatgacaataagtagaaagagcctctattctaaggtaattcaactgtaaacttttaattaggtatctttttatttccccatagagtaaggcagtgttgacccttttccaaaccgcaataaaacatctggagagt

SEQ ID NO: 458077 - DNA, 273 bp, Homo sapiens
ccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaagtaagatgcacatttattctgcccacttcttagaatgacttccacctttttttcattatcagcagattttattcttcctgtatttatttcacttgggaaaacacttgttcagagag

SEQ ID NO: 458078 - DNA, 612 bp, Homo sapiens
tgtgcttgcaatcctctgggaacaattcctggagggaatccttgtgattccgagacaggtcactgctactgcaagcgtctggtgacaggacagcattgtgaccagtgcctggtaagtaaatcctcattacgtgggatgggtggttggtgaggatgacatgttttaatagagaagccttttcgccattgtagagtctgcgatcaccctcacgtgtacgtgttaaaagacatgagtagacaatgcacacaataggaattactaatggatgatttcacaagatgttcaccatccctgttagaagtgtaaaggaaagccacaataaaataccacttttatagacacaattaacacaagtttttaaaaatgggaatgtttactattaggatatcatgaggtactgctacttcttggctgctggtgggcatccatattggtttgtacttttgtgaaaagcattttggagatacatatcagtagcttgtagaaatgggcataccctttgacccagtaaccccacctctgggaatctattctaatgaaataatcagaaaattggacaaagatttattctccagaagactcattgcatcttttattaatcatagcagaaga

SEQ ID NO: 458079 - DNA, 503 bp, Homo sapiens
gcggccgcccgccccttcagccccggctctccgtatgcgcatgagcagaggcgcctccctctgttcctcccaaggctaaactttctaattcccttctttgggctcgggggctcccggagcagggcgagagctcgcgtcgccgggtgaggagaacaaagtggctgcacgattttcccccctttccagcccaccccccgcttccgtgggagcgacaggaaatggaagggcgcctcttctctctttgaacatttgccttttttcccctcctttccacctctccagaaaggaagacgggaagaaagggcaggcggctcggcgggcgtcttctccactcctctgccgcgtccccgtggctgcagggagccggcatggggcttctccagttgctagctttcagtttcttaggtaattccgtggaaacggtgcggggaggcggacggacttgggcatggggaaggaaaacccaaaagctgcttgctcaccttcgtgggatcctgggggct

SEQ ID NO: 458080 - DNA, 619 bp, Homo sapiens
gtgactctgcaggatcctttaagctctctctgatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagagctgcaggtaccggctcgattctaa

SEQ ID NO: 458081 - DNA, 5616 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458082 - DNA, 6975 bp, Homo sapiens
  misc_feature (5952)..(5952): n is a, c, g, or t
  misc_feature (6002)..(6002): n is a, c, g, or t
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaanaaaaaaaaaaaacaaaaaaaaaaaaaaaacacaaacaaacaaaaaaaaanaaaaaaaaaaaaaggggggggggcccgcaaaatcccccggggggggcgccacaagcagaccagaccaccacaatttattgaaaaaaaggagagcgccaaaaagagagacgacctaatatataaaaacgacggagaggagacgaggaacaaaacaaagacgaaagacaggagaaaaagaagacaagaagagaggcgacatccgagagaagaagaaaacaaacaaaagggggggaggagggaaaaaaacatatcgagccaaacaacaaccaaaagagagaaataataagaccacaacgacagagacaaaaacaaaacaaaacaacacggagcaaacacagaaggtgaaacaaaaaacacagaaacaataaacgaagacgccgaagaaaagaaaagagcaagagcaccagcaccaggcgcgagatcaaccgatcaaacagcacacaacaaccactatccaccaccagcgggggcgggcctaataaccgaacaagacacaagcaacacgaccgaacaacacaccacgccacaaccccacgccgcaaaaacacaacagaccacaacaacacgaccacaccggaccacgacaaaacaaaaaacaaacagcaaagaaaaagggaagacgagaaggagaggggaaagagaaggaacaggaacgagagagcaaaagagaaaacagggaaagcaagaggaagacaaaaagagagaagagaaagatagaaaacacagacaaaaagggaaaaggaaagaagacgaaaaagagaaaaggaagagcgccacagcgaccacacgaggaggcagcgggaggagaaacgacgacaagagacagaggagaaagaaaaaaccaaaacaaagaccggccaacacggccaaagcggcgaaaaaaggaagaagcagaaggagaacaagaggaaacagaagagaggagaggcgggaagaacggccgagaagaagaaagacgggaggaaggaaacgc

SEQ ID NO: 458083 - DNA, 6922 bp, Homo sapiens
  misc_feature (5899)..(5899): n is a, c, g, or t
  misc_feature (5949)..(5949): n is a, c, g, or t
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatataaaaaaaaaaaaaaaaaaaaaaaaaaaaaaaaaaaaaaaaaaaaacaaaaanaaaaaaaaaaaacaaaaaaaaaaaaaaaacacaaacaaacaaaaaaaaanaaaaaaaaaaaaaggggggggggcccgcaaaatcccccggggggggcgccacaagcagaccagaccaccacaatttattgaaaaaaaggagagcgccaaaaagagagacgacctaatatataaaaacgacggagaggagacgaggaacaaaacaaagacgaaagacaggagaaaaagaagacaagaagagaggcgacatccgagagaagaagaaaacaaacaaaagggggggaggagggaaaaaaacatatcgagccaaacaacaaccaaaagagagaaataataagaccacaacgacagagacaaaaacaaaacaaaacaacacggagcaaacacagaaggtgaaacaaaaaacacagaaacaataaacgaagacgccgaagaaaagaaaagagcaagagcaccagcaccaggcgcgagatcaaccgatcaaacagcacacaacaaccactatccaccaccagcgggggcgggcctaataaccgaacaagacacaagcaacacgaccgaacaacacaccacgccacaaccccacgccgcaaaaacacaacagaccacaacaacacgaccacaccggaccacgacaaaacaaaaaacaaacagcaaagaaaaagggaagacgagaaggagaggggaaagagaaggaacaggaacgagagagcaaaagagaaaacagggaaagcaagaggaagacaaaaagagagaagagaaagatagaaaacacagacaaaaagggaaaaggaaagaagacgaaaaagagaaaaggaagagcgccacagcgaccacacgaggaggcagcgggaggagaaacgacgacaagagacagaggagaaagaaaaaaccaaaacaaagaccggccaacacggccaaagcggcgaaaaaaggaagaagcagaaggagaacaagaggaaacagaagagaggagaggcgggaagaacggccgagaagaagaaagacgggaggaaggaaacgc

SEQ ID NO: 458084 - DNA, 2097 bp, Homo sapiens
gactcagctacagcgagttcagaccatgtaccagggagcaagccaggagaccggtgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458085 - DNA, 6054 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaaggtatctaaagacatggcatctaaggggcttattttgtgtatctatcatggagtaaaaagtatctctttaaccaatgaaacttctaagaaggacctatgcgagtctctctgggtcatttcaggaaggctattctttaaagaaaagaacactgagagtacttttttcatgttcagcaacaatatactgtctcattattttttactcagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458086 - DNA, 5311 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagagctgcaggtaccggctcgattctaa

SEQ ID NO: 458087 - DNA, 5640 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgaccccaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458088 - DNA, 5173 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaagtgcacagatgtaaagtctcctccagatatgatacaggtagctctggcagaagcaggaagcatggcagacagcaggaatcaggttttga

SEQ ID NO: 458089 - DNA, 1504 bp, Homo sapiens
tcgagctcggtaccccgccatttacaactatctcaaatctccatatctgcattcacaagtttctgagctattcgtccaacctcaattaaaagatttcattgcctttaagtctcagctttaagctctggccctctatggttttccacaatgttcagattcactctgctatactttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaaacaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttgtatata

SEQ ID NO: 458090 - DNA, 5601 bp, Homo sapiens
  misc_feature (4628)..(4628): n is a, c, g, or t
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaaaaaaaaaaaaaaacaaaaaaaaaaaaaaaacacaaacaaacaaaaaaaaanaaaaaaaaaaaaaggggggggggcccgcaaaatcccccggggggggcgccacaagcagaccagaccaccacaatttattgaaaaaaaggagagcgccaaaaagagagacgacctaatatataaaaacgacggagaggagacgaggaacaaaacaaagacgaaagacaggagaaaaagaagacaagaagagaggcgacatccgagagaagaagaaaacaaacaaaagggggggaggagggaaaaaaacatatcgagccaaacaacaaccaaaagagagaaataataagaccacaacgacagagacaaaaacaaaacaaaacaacacggagcaaacacagaaggtgaaacaaaaaacacagaaacaataaacgaagacgccgaagaaaagaaaagagcaagagcaccagcaccaggcgcgagatcaaccgatcaaacagcacacaacaaccactatccaccaccagcgggggcgggcctaataaccgaacaagacacaagcaacacgaccgaacaacacaccacgccacaaccccacgccgcaaaaacacaacagaccacaacaacacgaccacaccggaccacgacaaaacaaaaaacaaacagcaaagaaaaagggaagacgagaaggagaggggaaagagaaggaacaggaacgagagagcaaaagagaaaacagggaaagcaagaggaagacaaaaagagagaagagaaagatagaaaacacagacaaaaagggaaaaggaaagaagacgaaaaagagaaaaggaagagcgccacagcgaccacacgaggaggcagcgggaggagaaacgacgacaagagacagaggagaaagaaaaaaccaaaacaaagaccggccaacacggccaaagcggcgaaaaaaggaagaagcagaaggagaacaagaggaaacagaagagaggagaggcgggaagaacggccgagaagaagaaagacgggaggaaggaaacgc

SEQ ID NO: 458091 - DNA, 4323 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccggcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagatgtggaagacgtgactcagtttcctgattacccagggtcacataacatgtgtggagaaggcaggatttaccacctcagtccgcagttcatgctcttaaccataatgctgtactcctcaaacctgccactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagaggaaggccgggcgcggtggctcacgcctgtaatcccagcacttcgggaggccaaggtgggcggatcacaaggtgaagagatggagaccatgctggccaacatggtgaaaccccgtctctactaaaaatacaaaaattagctgggcatggtggtgcatgcctgtagtcccagctatttaggaggcagaggcagaatagcttgaacccgggaagtggaggttgcagtgagccgagatcatgccactgcactccagcctgggagacagagtgag

SEQ ID NO: 458092 - DNA, 3784 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttttcacggggcagtgccagtgcatgcctgggtttggaggccgcacctgcagcgagtgccaggaactcttctggggagaccccgacgtggagtgccgagatgtggaagacgtgactcagtttcctgattacccagggtcacataacatgtgtggagaaggcaggatttaccacctcagtccgcagttcatgctcttaaccataatgctgtactcctcaaacctgccactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagaggaaggccgggcgcggtggctcacgcctgtaatcccagcacttcgggaggccaaggtgggcggatcacaaggtgaagagatggagaccatgctggccaacatggtgaaaccccgtctctactaaaaatacaaaaattagctgggcatggtggtgcatgcctgtagtcccagctatttaggaggcagaggcagaatagcttgaacccgggaagtggaggttgcagtgagccgagatcatgccactgcactccagcctgggagacagagtgag

SEQ ID NO: 458093 - DNA, 336 bp, Homo sapiens
agttgatcacaccaacccatgagcattctgaattggggacagggtgcttataaaaggagcatgtttccattgaatgagtttctcaaggcagttccttgtttgcctgtttctttagcttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcat

SEQ ID NO: 458094 - DNA, 2027 bp, Homo sapiens
ggaaacagagagagaacagaagaagagaaagctcagcaaattttcttgccatacttcatgacttcactgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtctaagtc

SEQ ID NO: 458095 - DNA, 755 bp, Homo sapiens
ggaaacagagagagaacagaagaagagaaagctcagcaaattttcttgccatacttcatgacttcactgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatctcctaagagagccttatgattggctccaattgggactcaggcctaattaccacgttttgggtccctaacaggtctgtacatttgcccgggaaataaaggaaaccactca

SEQ ID NO: 458096 - DNA, 1410 bp, Homo sapiens
ggaaacagagagagaacagaagaagagaaagctcagcaaattttcttgccatacttcatgacttcactgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggcacttgagtcgtactctgtgaattggcctacctcgtaataatcctggaaaccttgtggtagctcagactcgtagaaggaattgctgaagcgccagaggaaatg

SEQ ID NO: 458097 - DNA, 2098 bp, Homo sapiens
ggaaacagagagagaacagaagaagagaaagctcagcaaattttcttgccatacttcatgacttcactgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtctaagtcttccagattccatttaaaaccatttcttgttctcctacgtgagtgaaagatgatcatatatcctaatgctt

SEQ ID NO: 458098 - DNA, 1958 bp, Homo sapiens
gtctgtggtcggtgccggagatctagaggataggagacatccaggtgctgaagccatcatatactgtctcagtgtttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtctaagtc

SEQ ID NO: 458099 - DNA, 3841 bp, Homo sapiens
catgtttatatctcctttcttttgtttgctctgtttcgctgttgtcactatgccgttttttagttctcgtatgcctcatctttctggtgtctttgtccgtttgtgttgtccagtgggtttgtgtcttgcatgtccacgctgtccgttttcccacgttctgatggtgtattgcgcgtccttttgtgtttttaattgtctctcttttgggcccctttggtcatcgtgacgtgggttcgctggtatcttggtgcccttctgggttatctctccttgtcgtgctccctcttgttttttctttttgttttttttcttcttgtttctcagcacaatcgacatttatttacgtaggtaaaattactgttgctatgggtaaattcacagaaataaagcccagagaatccggttggctggcagggagcggcggaaccaatcccgggctcagcaagttctcgcgataccgtgagatctccagtcctgacgacaccgccgctgaaatgttagtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtggtgaagggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgctaaaaaaaaaaaaaaaaaatttgggggcgggccgaaagtttaaaattgggggggggccatgtaagacggcacggtcaagacgggcaagggggtcccaaaagcggcggggtgaaagggggggtggccaaggcgta

SEQ ID NO: 458100 - DNA, 2239 bp, Homo sapiens
gatagggtcgagatgcagagatgtgagggtacgtggactcctctagaaggtcgaccggacatgcgacatgaccacgtatgagccgggggccggcgcaagtacacgtcgagaatgggcccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgcta

SEQ ID NO: 458101 - DNA, 4032 bp, Homo sapiens
catgtttatatctcctttcttttgtttgctctgtttcgctgttgtcactatgccgttttttagttctcgtatgcctcatctttctggtgtctttgtccgtttgtgttgtccagtgggtttgtgtcttgcatgtccacgctgtccgttttcccacgttctgatggtgtattgcgcgtccttttgtgtttttaattgtctctcttttgggcccctttggtcatcgtgacgtgggttcgctggtatcttggtgcccttctgggttatctctccttgtcgtgctccctcttgttttttctttttgttttttttcttcttgtttctcagcacaatcgacatttatttacgtaggtaaaattactgttgctatgggtaaattcacagaaataaagcccagagaatccggttggctggcagggagcggcggaaccaatcccgggctcagcaagttctcgcgataccgtgagatctccagtcctgacgacaccgccgctgaaatgttagtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtggtgaagggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgctagatttcttatttttcaccttacccataaatgtaatgcttgaatgaagttgttcatattaattaaaaattatggaatcattaaagtcctttaatccattaaagttcttaatggattaaaatcattaaagttcttaatggattaaaacaaaaaaaacaactaagacaacacaagcgaaaaaaaacaaaaaaacgagaaaaaataaagggggggcgataacacaggggcacaaacacaattgagagggcaataaaagataaaagcgggaaaaggaggaattgatgaggcatttgggtttaacaaaaaagggatgtagactggagga

SEQ ID NO: 458102 - DNA, 1475 bp, Homo sapiens
tcacagggcatgtgcccatactgctcaatgcagagctgagtaggtggaacaggctcccaaagctagaaatccaagtgacagcaaccagttcagatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgcta

SEQ ID NO: 458103 - DNA, 1212 bp, Homo sapiens
  misc_feature (115)..(115): n is a, c, g, or t
  misc_feature (121)..(121): n is a, c, g, or t
  misc_feature (123)..(124): n is a, c, g, or t
  misc_feature (126)..(126): n is a, c, g, or t
  misc_feature (134)..(134): n is a, c, g, or t
gggccccatatttgatctgtcaagaaactgttggctgggaactcctgaggtcaggagttcgagaccagcctggccaacatagggaaaccccatctctactaaaaataaaaaaaanttagcngnncntggtggcncagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgcta

SEQ ID NO: 458104 - DNA, 2522 bp, Homo sapiens
catgtttatatctcctttcttttgtttgctctgtttcgctgttgtcactatgccgttttttagttctcgtatgcctcatctttctggtgtctttgtccgtttgtgttgtccagtgggtttgtgtcttgcatgtccacgctgtccgttttcccacgttctgatggtgtattgcgcgtccttttgtgtttttaattgtctctcttttgggcccctttggtcatcgtgacgtgggttcgctggtatcttggtgcccttctgggttatctctccttgtcgtgctccctcttgttttttctttttgttttttttcttcttgtttctcagcacaatcgacatttatttacgtaggtaaaattactgttgctatgggtaaattcacagaaataaagcccagagaatccggttggctggcagggagcggcggaaccaatcccgggctcagcaagttctcgcgataccgtgagatctccagtcctgacgacaccgccgctgaaatgttagtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtggtgaagggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgaaggatgacctcgtagcatgtgatattccagaacagcatgaaggtcatatggaagtggagaagcatacccaccaccgtctcaatcttgaggttgagagaactgaatatccaaagggaacagggtgcagaaaagtcgtcgacg

SEQ ID NO: 458105 - DNA, 3709 bp, Homo sapiens
catgtttatatctcctttcttttgtttgctctgtttcgctgttgtcactatgccgttttttagttctcgtatgcctcatctttctggtgtctttgtccgtttgtgttgtccagtgggtttgtgtcttgcatgtccacgctgtccgttttcccacgttctgatggtgtattgcgcgtccttttgtgtttttaattgtctctcttttgggcccctttggtcatcgtgacgtgggttcgctggtatcttggtgcccttctgggttatctctccttgtcgtgctccctcttgttttttctttttgttttttttcttcttgtttctcagcacaatcgacatttatttacgtaggtaaaattactgttgctatgggtaaattcacagaaataaagcccagagaatccggttggctggcagggagcggcggaaccaatcccgggctcagcaagttctcgcgataccgtgagatctccagtcctgacgacaccgccgctgaaatgttagtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtggtgaagggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgcta

SEQ ID NO: 458106 - DNA, 3932 bp, Homo sapiens
catgtttatatctcctttcttttgtttgctctgtttcgctgttgtcactatgccgttttttagttctcgtatgcctcatctttctggtgtctttgtccgtttgtgttgtccagtgggtttgtgtcttgcatgtccacgctgtccgttttcccacgttctgatggtgtattgcgcgtccttttgtgtttttaattgtctctcttttgggcccctttggtcatcgtgacgtgggttcgctggtatcttggtgcccttctgggttatctctccttgtcgtgctccctcttgttttttctttttgttttttttcttcttgtttctcagcacaatcgacatttatttacgtaggtaaaattactgttgctatgggtaaattcacagaaataaagcccagagaatccggttggctggcagggagcggcggaaccaatcccgggctcagcaagttctcgcgataccgtgagatctccagtcctgacgacaccgccgctgaaatgttagtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtggtgaagggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgctagatttcttatttttcaccttacccataaatgtaatgcttgaatgaagttgttcatattaattaaaaattatggaatcattaaagtcctttaatccattaaagttcttaatggattaaaatcattaaagttcttaatggattaaaacattacaacacactcacacaaaattttcggcgcttggccctaaaattttaaacaaccgtgggccgggcccagtatgac

SEQ ID NO: 458107 - DNA, 474 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccattt

SEQ ID NO: 458108 - DNA, 1315 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458109 - DNA, 453 bp, Homo sapiens
gctatcctagaggttcccgagctttaccgcctaggtagaagagtgagactctgtctcagaaaatacacataatataatataacaaatagataggaatgggctttaacattggagtccggctgattgaagatttcttggctcggtcaaatgttgggaggtgccatgactttcgggaaactgcggatgtcattgccaaggtcattattctgggccacctgtccatgctgaagaattgctgctgagaggcactgcttaccactctttctatctcccttagagaggcctttaatctcccaaaagactggctaggcagctctttgggtcaaaaaaacattccaggtcgttagggaatagcatagattatttaatccctgtggattaaagccccactgaaatcaaagcctgagcttttccactgtgaaggtgtagcagagtagcatgggggtaaagaat

SEQ ID NO: 458110 - DNA, 1339 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaagtgaaatcccaatcatgtcctgtt

SEQ ID NO: 458111 - DNA, 1338 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaaaacaaaaacaataaaacaacggg

SEQ ID NO: 458112 - DNA, 1560 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458113 - DNA, 1370 bp, Homo sapiens
  misc_feature (1255)..(1255): n is a, c, g, or t
  misc_feature (1308)..(1308): n is a, c, g, or t
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatggtggtgtatgcctgtagtcccagccacccagaaggctgaggcaggaggatcgcttgagaccaagagtttgagcctgcggtnagctgttaatgaccacggcactcaagcctgggcaatgtagcaagatcctgttntctacaagaaattttttaaaaattgagccaagtttgggtggtgcatgcctgtagttccacta

SEQ ID NO: 458114 - DNA, 1392 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgagagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458115 - DNA, 1551 bp, Homo sapiens
tgttatttcgatgcaagaggcgggcgctgtcattgtgtatctggctgttcgctgggtgttgccttttctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacgagctctgagctcttcaccctgacctatggtgccctggtcacccagctatgtaaggactatgaaaatgatgaagatgtgaataaacagctggacaaaattctcttctctaacttccttcccaggggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458116 - DNA, 1788 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtgagtgcaactctttatcttctgggacacccgaaatgcaatagggacttgataagtgtttaaatgaatgaaagagagaaaagaaagggctttggctcaccccagcgctttactgcctgagatggtgatgctgctgaggtaggatccaagtcggacatctttacatggtgatactcctccataccaggctggtggaaggtggtgctgtcagtccccaaagcccaggaacatccattctcagataggcttatttggtgacagtctcattcttgggtattctttgctaagtttctccttaagggttggagccattgtcttatgcaacagaatgttggcgctgtcaatcttgtccttgtgggaaaccagccccccttttttggatgctgtggatgagtcagttatgccccatccccactggttccctagaggctgtggccaggcagctaccccttcattttcccactgtcccccaggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458117 - DNA, 1002 bp, Homo sapiens
tcagtgattagagatactgagctaagtcaatgtggaggtccagactttcggaacgcggagtcatgccagtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458118 - DNA, 934 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458119 - DNA, 1100 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccattt

SEQ ID NO: 458120 - DNA, 991 bp, Homo sapiens
tgttatttcgatgcaagaggcgggcgctgtcattgtgtatctggctgttcgctgggtgttgccttttctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacggtaataaataccagtaactgccacttacttctctcttactatgtgttgggcaccgggccacgcacgttacagcatctcagttaatctgcagagtagcccctatcagatggataacattgccgttttacagcttggagagcttacgtaatttgcccatatttacacctgggaagttaggatttggacccgtgtttaactccaaagctaatgctaggagctgactgttaggctttactcttaggctacagtgtctcgtactgtggcgtgggtattgtgagagatgttcagatactggtcgtgccagaaaggaacgttttattcaatggaataagagatgggccagaagtaagcagtgagtggtgcccctctaatggagtgggtggctcccttctttcccagggaatagtttggacaccatatggtcctataaagttggactaggggctggggctgcagacttaggtcatttttctttcgttcttccctccctccccccgcccccagacgaaatctctgtcacccggggtggagtgcagtgagccgagatcacatcactgcattccatcctgggtaacagagcaagactccatctaaaa

SEQ ID NO: 458121 - DNA, 829 bp, Homo sapiens
tgttatttcgatgcaagaggcgggcgctgtcattgtgtatctggctgttcgctgggtgttgccttttctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaagtgctgggattacaagcgtgagccactgtgcccggcaccagttacctcatctttaacatgaagaaaataagagctacccccagggctgttttaaggagtaaatgaataatggacatgaacatttaggtaaaatgctagtgtttagcatagtgttgtgcatatagtaaatgtttactattactagtattagtgctatctgttatagtattaataaatgacatagcacccataactttg

SEQ ID NO: 458122 - DNA, 1915 bp, Homo sapiens
  misc_feature (1332)..(1333): n is a, c, g, or t
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaaaaaaaaacaaaacaaannaacaaagacaagaaaaagaagaaaacacagagcgggcgtgcgcgcggcacaaagaaatctcgcgcgaaaggtgggcaacgaaggaaaaaggggacaacccaggagtcaatggtgcacaagaggaggcggcaccacactaagcaggcgggacatacatacgcgcagggagcggccgagagcgacgagcagctaaaaaaaaaggggagaagaccggggaaaccaaccggcgacgacacccgaggaaaaacccagggaaccggcggagagcaccacacaacaccacgcgcaagcaatagaacagacactccaggcggggcagcacaccccacccaccaccacacgcaagaaacaagacgacagccgccccgaagagggagaagaacaaagacgaaaacgccagcgacccagcggggacccaacacaaccgggtgcgagaagacagcaggcgacgaaggagatgaatagggaaagacaggccacccacagacacaaggcggctgacgcctacacgcaaggcacactcgaaacgcgcgggaggcaacacaccataaccacccccagcgcgcacagcgcgacgcagca

SEQ ID NO: 458123 - DNA, 855 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccattt

SEQ ID NO: 458124 - DNA, 1370 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaaaacacacacaccaaaaaacaaaaaaaaccggggggataatggggggggggaaaag

SEQ ID NO: 458125 - DNA, 1882 bp, Homo sapiens
  misc_feature (1299)..(1300): n is a, c, g, or t
tgttatttcgatgcaagaggcgggcgctgtcattgtgtatctggctgttcgctgggtgttgccttttctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaaaaaaaaacaaaacaaannaacaaagacaagaaaaagaagaaaacacagagcgggcgtgcgcgcggcacaaagaaatctcgcgcgaaaggtgggcaacgaaggaaaaaggggacaacccaggagtcaatggtgcacaagaggaggcggcaccacactaagcaggcgggacatacatacgcgcagggagcggccgagagcgacgagcagctaaaaaaaaaggggagaagaccggggaaaccaaccggcgacgacacccgaggaaaaacccagggaaccggcggagagcaccacacaacaccacgcgcaagcaatagaacagacactccaggcggggcagcacaccccacccaccaccacacgcaagaaacaagacgacagccgccccgaagagggagaagaacaaagacgaaaacgccagcgacccagcggggacccaacacaaccgggtgcgagaagacagcaggcgacgaaggagatgaatagggaaagacaggccacccacagacacaaggcggctgacgcctacacgcaaggcacactcgaaacgcgcgggaggcaacacaccataaccacccccagcgcgcacagcgcgacgcagca

SEQ ID NO: 458126 - DNA, 1217 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgcaacatctcctctttttacagagggtacatccttttttcttacaaattcttcaataaagacacattcttgagtgaaatcccaa

SEQ ID NO: 458127 - DNA, 1258 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458128 - DNA, 1261 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggtttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458129 - DNA, 1084 bp, Homo sapiens
tgttatttcgatgcaagaggcgggcgctgtcattgtgtatctggctgttcgctgggtgttgccttttctaacccgtggctaggcgagtggggcggggcggccggcaccatgtcgaggcaggcgaaccgtggcaccgagagcaagaaaatggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458130 - DNA, 1734 bp, Homo sapiens
agcgggcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtgagtgcaactctttatcttctgggacacccgaaatgcaatagggacttgataagtgtttaaatgaatgaaagagagaaaagaaagggctttggctcaccccagcgctttactgcctgagatggtgatgctgctgaggtaggatccaagtcggacatctttacatggtgatactcctccataccaggctggtggaaggtggtgctgtcagtccccaaagcccaggaacatccattctcagataggcttatttggtgacagtctcattcttgggtattctttgctaagtttctccttaagggttggagccattgtcttatgcaacagaatgttggcgctgtcaatcttgtccttgtgggaaaccagccccccttttttggatgctgtggatgagtcagttatgccccatccccactggttccctagaggctgtggccaggcagctaccccttcattttcccactgtcccccaggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 458131 - DNA, 2775 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctgggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggcccagttctcaccggggaaaaaacccactgttaggatggccatgaaacatttcccttagaatcgtggtcaagctcccgaggaatgtggcgtcccaggctctttgaagagccatgggctgcaccccggccgtaggcctagtgtaactcgcatccccattgcagtgcccgtttccttgactgtgttgctgtctcttagattaaccgtgctgaggctcccacatagctccctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagat

SEQ ID NO: 458132 - DNA, 1075 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccc

SEQ ID NO: 458133 - DNA, 613 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagactccgctgcccccgactccctgctgagaagttcaaagggcagcacgagggggtctttggctgctattgtcatctggagggggaagagtgagagccggatagccaagaccccaggcattttcagaggtggcgggaccttagtcctacccccaacacacacccct

SEQ ID NO: 458134 - DNA, 1123 bp, Homo sapiens
cgggacatgatacaatcgagctcggtacctagtgtgtagctagtatgcgccagaatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggcccagttctcaccggggaaaaaacccactgttaggatggccatgaaacatttcccttagaatcgtggtcaagctcccgaggaatgtggcgtcccaggctctttgaagagccatgggctgcaccccggccgtaggcctagtgtaactcgcatccccattgcagtgcccgtttccttgactgtgttgctgtctcttagattaaccgtgctgaggctcccacatagctccctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagat

SEQ ID NO: 458135 - DNA, 1104 bp, Homo sapiens
gagcggagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgcccggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccc

SEQ ID NO: 458136 - DNA, 1027 bp, Homo sapiens
gagcggagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggccccggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccc

SEQ ID NO: 458137 - DNA, 841 bp, Homo sapiens
gcccaatcctgttgaggtgaaatgagccgattgtgctcatcagaggcagttggacatttttgtcctcgcatctggctggtcatcatgaattactctggagggagagatgttgacctgtctaaccaaaaaagcatttatgtctctgagccagcactcccttctctgcggccagcagactcctctaacgaggggggtgtcttcagcaactgggaggtagctcatcttggcaaacgttgttgacacaggcatctctccgagtttccaattttggggtgctgtggctctgggggaagaaaagcaagcgcttgcctatactgtgctaaaccgcattaaaaaaattccaacagaaattgtgacgagggaatctcaataactcttaaagcagtttgttttgactaactcgagcattacagtgggatttttctaactgaccatgcaaatatgtgtttcctgatggctgtctgtttcaggcaggctagtgagctagttcttcaacggtatttcattttcttacttgcagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccc

SEQ ID NO: 458138 - DNA, 1028 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaaaataaaagagaaaacaaagcagagaagatgggagggccagagagcgagaggaagaccacaggagagaagacactgaacgagcttcccttgttttgcctggaagcccacgctggctccctggctctgcccaggatgtgcagtccaaatcccaatccagcagtggggttatgtcgtcccgcttaccctcagagcccttctcctggtgctgcccagacgatcagccagtccctcctggagaggttctgcatggcctctaggagagaagttttcttggccccaggaaggcctggtggagggtggtggttgtgcactgttgctggacagatgcattcattcatgtgcacacacacacacacacatgcacacacaggggagcagatacctgcagagaagagccaaccaggtcctgattagtggcaagctgccccacaaagggctatgcctgtgtcttattgagacaccttggcaaagagatggctgattctgggtggtcctggacatggccgcacccaagggccctccaagccttaatggcaccctgaagcctccatgcccaggccaaaagatgcttttcctccct

SEQ ID NO: 458139 - DNA, 2804 bp, Homo sapiens
gagcggagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgcccggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctgggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggcccagttctcaccggggaaaaaacccactgttaggatggccatgaaacatttcccttagaatcgtggtcaagctcccgaggaatgtggcgtcccaggctctttgaagagccatgggctgcaccccggccgtaggcctagtgtaactcgcatccccattgcagtgcccgtttccttgactgtgttgctgtctcttagattaaccgtgctgaggctcccacatagctccctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagat

SEQ ID NO: 458140 - DNA, 1700 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagat

SEQ ID NO: 458141 - DNA, 575 bp, Homo sapiens
  misc_feature (18)..(18): n is a, c, g, or t
  misc_feature (49)..(50): n is a, c, g, or t
  misc_feature (71)..(71): n is a, c, g, or t
  misc_feature (98)..(98): n is a, c, g, or t
tgcccctggtggagctgngcagacacccatgtatacccacagcatcgcnncctgatgaaggaggcaaaggnttgatcttctatgacacgaaggtaccntgatgaatcgagtgctgaatgccactgtgcagaggacagcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccc

SEQ ID NO: 458142 - DNA, 2531 bp, Homo sapiens
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458143 - DNA, 2278 bp, Homo sapiens
gtgatccaccggcctcagcctcccaaagtgctgggattataggcgtgagccactgcacccgtcctaatttttgtatttttagtagagatggggtttcaccatgttggctaagctggtctggaactcatggcctcaagttatctgcccacctcagcctcccaaagtgctgagtaagccaagttttctaatagccacattagacaagtaaaaggaaacaggttaaattcattttaacatgttttacttaacccaatgtatccaaaatagcatttcaacatgtcatcggttttttagttttttttttttttgagatagtgcttcgctttgttgcccaggctggagtgcagtggcacaatctcggctcactgcaacctccaccttccaggttcaagtgattctcctgcctcagcctcccgagtagctgggattacaggcacccgccaccatgcccactaatttttgtatttttggttagagatggggtttcgccatgttggccaggctagtctcaaactcctgacctcaggtgatccacccacctcggcctcccaaagtgctaggattacaggcgtgaggcaccgtgcctggcgtcatcggtattatttaaatgaattatgttacgttcttttgtgctgtcttcaaaatctgttatatattttacacttacaccaaatctcaattaccatggtacatttttatctgaaatgcttgacctttattttgatttcataaaattcatagttggagaagtagattcacatatccaagttgttccaattatataatagttttccaaaaactgagatgggtgtccattttttttttaagtaaagatgcaggtctggttatgttgaccaagttgctgggttgttttgttttgttttgagacagagtctcactttgtcacccaggctggagtgcagtggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggcctcccaaagtgctggtattacaggcatgggccaccacacctggcctcagctgttcaattaaaagtaaatacaacttaaaattctatgtttcattggcagtagtgcaacattaatactgagtagccacatgtgattagtggctatggtattggacagggaaggtacagaatacttccatcaacatagaaaattctatcagtctagctctaggggcagatagtccttccactgacttgggcaagtcactctacaaatggcatctacctcacatggttatggtgagaattcagcgtatgtatgtacatgcaggcacacaatatgcacacagacacataacatagtacaccctttcctgaaaagcctgacacatggagctcaaacatgagtgccacccacccctgggcagcaccaagatggctctagtctgggtgcctttgtctcacccccatgcctttgctcggagtgtgctcctcatttttctgccactttgaccctgtctctgatttggtcctgtctgacatcactgctatatgctttgctcctctcaatttcctctgccctcatgccagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgatggagggatttgtgtccactgcagtggggaaccatgaaggacacatcaagggtgtggttggcctgtggtgctctttggaggaatgaataaaaatgaatagaaatccta

SEQ ID NO: 458144 - DNA, 2515 bp, Homo sapiens
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctacacacacacacacacacacacacgatgcatttaataaagatgagttggttctca

SEQ ID NO: 458145 - DNA, 3108 bp, Homo sapiens
  misc_feature (2535)..(2535): n is a, c, g, or t
  misc_feature (2537)..(2537): n is a, c, g, or t
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatgggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtananaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctcagcgtccccaggccagggatagtgcctttcctccagggttttcagaagtagctgtataatgaatgtcaccactgtggttttacatcacctaatttaggaggtagaatgggaggaagggacattttaagcaacctacccaaaccctgcacccccttcaaggctccaccacatttaagtgggaattgaggtgattgtgagggaatcagggcagaggatgggatggtgctctaggcagaggccatagcatgggccaggaggtgggaagcagcctgaggcaggcagaagagcattgctgcctttggcaaagaggctttgggggcagatttagaaagccaggcacagtccttgcagctctgctgtccagtgtgatcaccactgggtac

SEQ ID NO: 458146 - DNA, 2150 bp, Homo sapiens
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458147 - DNA, 2075 bp, Homo sapiens
attccaatgcacgggaccgggctttcagttgataaactacatggccctcggcctgtccacatttcacaccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458148 - DNA, 2544 bp, Homo sapiens
cgctactggctgtgcggaacctccgtcctggggattcacagactgccgcccaggcccgtgatcagacagcagctctgctgaacagcgcggggttaggagctgcggatctgtttgtgctaccggcgaactgcggcagcagcgacggctgcgaggagctagagcgcctccgggcggcgctgcagagccaggcagaagcgctgcgcaggctcctgccaccggcgcaggatggcttcgaggtgttgggtgcagcagagctagaggctgtgcgtgaggcctttgagaccggcggccttgaggctgcgctgtcgtgggtgcgctcaggcctggagcgcctgggcagcgcacggctagacctggccgtggctggcaaggctgacgtgggccttgtggtggacatgctgcttggattggatcctggcgacccaggcgctgcgcctgcttcggtccccacagcacccactcccttcccagccccagagcgcccgaatgtggtgctctggaccgtgcctctgggccacacgggcactgccaccaccgcggccgccgcctctcacccaacgcactacgacgccctcatcctcgtcacccctggggcccccactgagaaggactgggcccaggtccaggccttgctgctaccagatgcgcctcttgtctgcgtgcgcacagacggcgagggcgaggatccggagtgtctgggagaagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458149 - DNA, 1877 bp, Homo sapiens
ggagagactgagggagtattgcagcggtcaccaacatgttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458150 - DNA, 1664 bp, Homo sapiens
ggagccaggaagaggtttccctgagtgaaaagggtcttgggccctggcctctgtccttgggccagactccctgactcccacccctcctttcccaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458151 - DNA, 2356 bp, Homo sapiens
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458152 - DNA, 1575 bp, Homo sapiens
tacacgtctggctggcagtcatgcacggttgcgataatggccgccgactaacatggtgctgacgggcgcgtacaccctgagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458153 - DNA, 2392 bp, Homo sapiens
gtgatccaccggcctcagcctcccaaagtgctgggattataggcgtgagccactgcacccgtcctaatttttgtatttttagtagagatggggtttcaccatgttggctaagctggtctggaactcatggcctcaagttatctgcccacctcagcctcccaaagtgctgagtaagccaagttttctaatagccacattagacaagtaaaaggaaacaggttaaattcattttaacatgttttacttaacccaatgtatccaaaatagcatttcaacatgtcatcggttttttagttttttttttttttgagatagtgcttcgctttgttgcccaggctggagtgcagtggcacaatctcggctcactgcaacctccaccttccaggttcaagtgattctcctgcctcagcctcccgagtagctgggattacaggcacccgccaccatgcccactaatttttgtatttttggttagagatggggtttcgccatgttggccaggctagtctcaaactcctgacctcaggtgatccacccacctcggcctcccaaagtgctaggattacaggcgtgaggcaccgtgcctggcgtcatcggtattatttaaatgaattatgttacgttcttttgtgctgtcttcaaaatctgttatatattttacacttacaccaaatctcaattaccatggtacatttttatctgaaatgcttgacctttattttgatttcataaaattcatagttggagaagtagattcacatatccaagttgttccaattatataatagttttccaaaaactgagatgggtgtccattttttttttaagtaaagatgcaggtctggttatgttgaccaagttgctgggttgttttgttttgttttgagacagagtctcactttgtcacccaggctggagtgcagtggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggcctcccaaagtgctggtattacaggcatgggccaccacacctggcctcagctgttcaattaaaagtaaatacaacttaaaattctatgtttcattggcagtagtgcaacattaatactgagtagccacatgtgattagtggctatggtattggacagggaaggtacagaatacttccatcaacatagaaaattctatcagtctagctctaggggcagatagtccttccactgacttgggcaagtcactctacaaatggcatctacctcacatggttatggtgagaattcagcgtatgtatgtacatgcaggcacacaatatgcacacagacacataacatagtacaccctttcctgaaaagcctgacacatggagctcaaacatgagtgccacccacccctgggcagcaccaagatggctctagtctgggtgcctttgtctcacccccatgcctttgctcggagtgtgctcctcatttttctgccactttgaccctgtctctgatttggtcctgtctgacatcactgctatatgctttgctcctctcaatttcctctgccctcatgccagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgatggagggatttgtgtccactgcagtggggaaccatgaaggacacatcaagggtgtggttggcctgtggtgctctttggaggaatgaataaaaatgaatagaaatcctaaaaaaaaaaaatatcttttctttaccaccttctctaaactcttacttctccctctttctctctcctttctcttctctccctctcatcttttatctacaaaaaaatggggcccat

SEQ ID NO: 458154 - DNA, 1454 bp, Homo sapiens
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458155 - DNA, 881 bp, Homo sapiens
acaatacaacgaaaatcataaaccataggctaggtacgaggccggtgtgaatcggccgaggcaaaatagtttgcagccagtccctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458156 - DNA, 2025 bp, Homo sapiens
  misc_feature (1452)..(1452): n is a, c, g, or t
  misc_feature (1454)..(1454): n is a, c, g, or t
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctcggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtananaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctcagcgtccccaggccagggatagtgcctttcctccagggttttcagaagtagctgtataatgaatgtcaccactgtggttttacatcacctaatttaggaggtagaatgggaggaagggacattttaagcaacctacccaaaccctgcacccccttcaaggctccaccacatttaagtgggaattgaggtgattgtgagggaatcagggcagaggatgggatggtgctctaggcagaggccatagcatgggccaggaggtgggaagcagcctgaggcaggcagaagagcattgctgcctttggcaaagaggctttgggggcagatttagaaagccaggcacagtccttgcagctctgctgtccagtgtgatcaccactgggtac

SEQ ID NO: 458157 - DNA, 3184 bp, Homo sapiens
  misc_feature (2611)..(2611): n is a, c, g, or t
  misc_feature (2613)..(2613): n is a, c, g, or t
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtananaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctcagcgtccccaggccagggatagtgcctttcctccagggttttcagaagtagctgtataatgaatgtcaccactgtggttttacatcacctaatttaggaggtagaatgggaggaagggacattttaagcaacctacccaaaccctgcacccccttcaaggctccaccacatttaagtgggaattgaggtgattgtgagggaatcagggcagaggatgggatggtgctctaggcagaggccatagcatgggccaggaggtgggaagcagcctgaggcaggcagaagagcattgctgcctttggcaaagaggctttgggggcagatttagaaagccaggcacagtccttgcagctctgctgtccagtgtgatcaccactgggtac

SEQ ID NO: 458158 - DNA, 2521 bp, Homo sapiens
  misc_feature (2489)..(2489): n is a, c, g, or t
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgcttatgtgagagattccgtgatcttttaaantgttactttttgtaacacaagaataattcaat

SEQ ID NO: 458159 - DNA, 2296 bp, Homo sapiens
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccaatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458160 - DNA, 2605 bp, Homo sapiens
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgctccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagggtgaaatcatcagactttggtggggtggaggaggagagaagctggaggcctcaatccatccccatcccctcagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458161 - DNA, 1991 bp, Homo sapiens
accgagagatcagaccatccgacgcaagtgtcgatgtacagcgagagaccaggactcgaactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458162 - DNA, 1894 bp, Homo sapiens
ctcggtacccggctgagcaagcgggcaggcgagaagaccatctctgtggtcctacttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458163 - DNA, 1972 bp, Homo sapiens
tgctgctgcaggcaggaaccactgcagcagcagaagcttaactgggggtgatgctcacaggatctgcaatgcacgagaagctggtccttcctccctcctgcagccttgcaaactctctctcttgccccccctattggcagagcctggtcacgatcagctagggaagcagaaaggtggtttgccaagtgcgggcccagatcacagagatgagttgtagagggtaggtttgagctgagaaacaatcacttaatacttagtgcagctcgcctgactctctggattctgttttctcatttccagcctctagtaattccccttgcctttccgctgactcacctgtgcatttccaaaaggtgtttgaatattgtgccagtttactgaatattctctgccgggaaagttccttaggacatgtagcccgctgtattgccagatatggaagactccatgggagaatttagataagggtcgctcacataaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458164 - DNA, 1579 bp, Homo sapiens
acttgaacccaggagccggaggttccagtgagccaatattatgccattacactccaggcctgggcaacaagagcaaaacttcatctcaagaaaaaaaaaattagccaggcgtggtggcaggtgcctgtcccagctactccggaggctgatgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccggaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctca

SEQ ID NO: 458165 - DNA, 1401 bp, Homo sapiens
cgctactggctgtgcggaacctccgtcctggggattcacagactgccgcccaggcccgtgatcagacagcagctctgctgaacagcgcggggttaggagctgcggatctgtttgtgctaccggcgaactgcggcagcagcgacggctgcgaggagctagagcgcctccgggcggcgctgcagagccaggcagaagcgctgcgcaggctcctgccaccggcgcaggatggcttcgaggtgttgggtgcagcagagctagaggctgtgcgtgaggcctttgagaccggcggccttgaggctgcgctgtcgtgggtgcgctcaggcctggagcgcctgggcagcgcacggctagacctggccgtggctggcaaggctgacgtgggccttgtggtggacatgctgcttggattggatcctggcgacccaggcgctgcgcctgcttcggtccccacagcacccactcccttcccagccccagagcgcccgaatgtggtgctctggaccgtgcctctgggccacacgggcactgccaccaccgcggccgccgcctctcacccaacgcactacgacgccctcatcctcgtcacccctggggcccccactgagaaggactgggcccaggtccaggccttgctgctaccagatgcgcctcttgtctgcgtgcgcacagacggcgagggcgaggatccggagtgtctgggagaaggcaagatggagaatcccaagggcgagagcttaaagaacgcaggtggagggggattggagaatgcactcagtaagggaagggagaaatgtagcgctggatcgcagaaagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgatggagggatttgtgtccactgcagtggggaaccatgaaggacacatcaagggtgtggttggcctgtggtgctctttggaggaatgaataaaaatgaatagaaatccta

SEQ ID NO: 458166 - DNA, 1486 bp, Homo sapiens
cgctactggctgtgcggaacctccgtcctggggattcacagactgccgcccaggcccgtgatcagacagcagctctgctgaacagcgcggggttaggagctgcggatctgtttgtgctaccggcgaactgcggcagcagcgacggctgcgaggagctagagcgcctccgggcggcgctgcagagccaggcagaagcgctgcgcaggctcctgccaccggcgcaggatggcttcgaggtgttgggtgcagcagagctagaggctgtgcgtgaggcctttgagaccggcggccttgaggctgcgctgtcgtgggtgcgctcaggcctggagcgcctgggcagcgcacggctagacctggccgtggctggcaaggctgacgtgggccttgtggtggacatgctgcttggattggatcctggcgacccaggcgctgcgcctgcttcggtccccacagcacccactcccttcccagccccagagcgcccgaatgtggtgctctggaccgtgcctctgggccacacgggcactgccaccaccgcggccgccgcctctcacccaacgcactacgacgccctcatcctcgtcacccctggggcccccactgagaaggactgggcccaggtccaggccttgctgctaccagatgcgcctcttgtctgcgtgcgcacagacggcgagggcgaggatccggagtgtctgggagaaggcaagatggagaatcccaagggcgagagcttaaagaacgcaggtggagggggattggagaatgcactcagtaagggaagggagaaatgtagcgctggatcgcagaaagcaggcagcggggaaggtcctgggaaagctggcagcgagggtttgcagcaggttgtcggcatgaagaaatcaggtggtggcgactcagagcgggccgctgcgttaagcccggaggacgagacgtgggaggtgctggaggaggcgccgccgccagtgttccccctacggcctggcggactcccagggctatgcgaatggctgcggcgagcgctccccccagcccaggcaggggcactgctgctggcgttgccaccagcatctcccagcgctgcccgaaccaaggctgcggcgttgcgagccggggcgtggaggccagctctgctggctagtctggcggcggcggcggcaccactcccagggctgggctgggcatgcgacgtggcacttctgcggggtcagctggcggagtggcgacggggcctggggctggaacccacggcactggctcgacgtgagcgtgccctgggcctggcttctggagagctggcagcgcgcgctcatttcccaggcccggtgacgcgcgccgaggtggaagcaagactgggcgcctgggcgggcgagggcactgctgggggcgcagcactgggggctctctccttcctgtggcctgcgggtggtgcagcggcgacaggtggcctgggctaccgagcggctcacggcgtcctgctgcaggc

SEQ ID NO: 458167 - DNA, 1678 bp, Homo sapiens
ccccaccccggccagatccctttcccagtcctgcttcccagtgcctcgggccaggaatcctggcctccgcctgcggagccggcggaacccgcttcccgcctccacggggcagcgccagcggcctggtcctttcaccggcagctccgtgccgacgctctcaccgctcttcctatcgccgggagtggcgggccgaccagggggcggccgggctaccgtccgccattcccgtgtctctgcgcccgcgggggccgcccgagccggccaccatgccgctgggcctgaagcccacctgcagcgtatgcaagaccacgtcgtcctccatgtggaagaagggagcgcagggggagatcctctgccatcattgcactggccggggcggcgcgggcagcgggggcgcaggctcgggggcggctggagggactgggggcagcggcggcggcggcttcggcgcggcgaccttcgccagcacctccgccacccctccgcagagcaacgggggcgggggcggcaagcagagtaagcaggaaattcacaggaggtctgctcggctcagaaacactaaatacaaatctgctccggctgctgaaaagaaagtctccaccaaaggaaaagggagaagacatatatttaaattgaaaaatcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaaattagccaggtgtggtggcatgtgcctgtaatcccagctatttgggaggctgaggcaggagaatcgcctaaacccaggaggtggaggttgtagtgagccaagattgcaccgctgtgctccagcctgggcaacagagtgagactcttgtctcggaaa

SEQ ID NO: 458168 - DNA, 361 bp, Homo sapiens
accttctgcataatgaattaactagaaataactttgcaaggagagccaaagctaagacccccgaaaccagacgagctacctaagaacagctaaaagagcacacccgtctatgtagcaaaatagtgggaagattaataggtagaggcgacaaacctaccgagcctggtgatagctggttgtccaagatagaatcttagttcaactttaaatttgccctttctggtgcagaaaagggagaagacatatatttaaattgaaaaatgtaagatatttgtggacagtgccttttactgtaatgacgttgtgtgtatcctgccactgccttcatttctcaccattgaacttggactctgcccttggt

SEQ ID NO: 458169 - DNA, 1737 bp, Homo sapiens
taagaaccaagatgtaaagcccttaagaaaatctcaatatacacatgtctacacagtcgtatacagtgtcatgccacaaatgcaggcgctggacctcattccttgttaaaggttttgtcatatcaggttatgaagtaagattattatgtcattattgtaaatggcagcttaagtattccgttgcagggggcgccataacctactacgttctctggccttagggagtaaagttgttaagtgtttttctctattgtagacacaacaaatgaatagtgtttgtcttggtcaagactgactcctactcccgcctcctgccctattacaagcagctcacaccttttggaggctctggagacgcctgtccagcgagctccgagattccgggtgctgaacttccggttttacttagcctagttgctgtaattacttctcttgaaaagcaaaagggcaatcttaattgttaaatgctcttataaagtacatactctgggatccttgtaagatgattgtactgcaacctttatgcactttttacttctttctctttttgttctttaatttgtttgtgtaacagagtaagcaggaaattcacaggaggtctgctcggctcagaaacactaaatacaaatctgctccggctgctgaaaagaaagtctccaccaaaggaaaagggagaagacatatatttaaattgaaaaatcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaaattagccaggtgtggtggcatgtgcctgtaatcccagctatttgggaggctgaggcaggagaatcgcctaaacccaggaggtggaggttgtagtgagccaagattgcaccgctgtgctccagcctgggcaacagagtgagactcttgtctcggaaa

SEQ ID NO: 458170 - DNA, 1234 bp, Homo sapiens
atcaaaatactttatgaacaaatcttttctccagatgtaaactgtcatatatgcaccctcgtatgtgtatgtataattttcattcaaacgtgaaacaactttagaattggcaccaaacatataaacactgatacattagactatctcgaacaccttttactgaccactttgaaaacttgcttacctattaaggttcattcatagctgtgatgttctatttttattttcaatgtgggattatcttctgtttcccccagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaaattagccaggtgtggtggcatgtgcctgtaatcccagctatttgggaggctgaggcaggagaatcgcctaaacccaggaggtggaggttgtagtgagccaagattgcaccgctgtgctccagcctgggcaacagagtgagactcttgtctcggaaa

SEQ ID NO: 458171 - DNA, 1502 bp, Homo sapiens
gccttagtttcagcttgctagaaaacctatgttgagtattatggctagttccatagttgagttgggaaatgtctttgaggagacactttttcactttgtattcatctgtacattttctgttacttgcattctgtcatgctcaggctattagagcaggtacatttttataactggaatgtttatgtgtagtgaagctctgagaggactttgcattagatctcagcagcataatcagaaggttgtcctttgtctcagcaatttttaagctaatagtagcagaaattgcagtggaaatagactgctttgccacaacattcagaaaatcatttatctttttattgcagttcttgtcaccaaacaatacattttagtacttctcaaattgcagaactctcatagggctgggaaaatgcctgtagacacatacatactatgaatgtgctaatgttttttgtattttcatagcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaaattagccaggtgtggtggcatgtgcctgtaatcccagctatttgggaggctgaggcaggagaatcgcctaaacccaggaggtggaggttgtagtgagccaagattgcaccgctgtgctccagcctgggcaacagagtgagactcttgtctcggaaa

SEQ ID NO: 458172 - DNA, 1624 bp, Homo sapiens
ccccaccccggccagatccctttcccagtcctgcttcccagtgcctcgggccaggaatcctggcctccgcctgcggagccggcggaacccgcttcccgcctccacggggcagcgccagcggcctggtcctttcaccggcagctccgtgccgacgctctcaccgctcttcctatcgccgggagtggcgggccgaccagggggcggccgggctaccgtccgccattcccgtgtctctgcgcccgcgggggccgcccgagccggccaccatgccgctgggcctgaagcccacctgcagcgtatgcaagaccacgtcgtcctccatgtggaagaagggagcgcagggggagatcctctgccatcattgcactggccggggcggcgcgggcagcgggggcgcaggctcgggggcggctggagggactgggggcagcggcggcggcggcttcggcgcggcgaccttcgccagcacctccgccacccctccgcagagcaacgggggcgggggcggcaagcagagtaagcaggaaattcacaggaggtctgctcggctcagaaacactaaatacaaatctgctccggctgctgaaaagaaagtctccaccaaaggaaaagggagaagacatatatttaaattgaaaaatcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaagcaggagaatcgcctaaacccaggaggtggaggttgtagtgagccaagattgcaccgctgtgctccagcctgggcaacagagtgagactcttgtctcggaaa

SEQ ID NO: 458173 - DNA, 1661 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458174 - DNA, 1620 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458175 - DNA, 1292 bp, Homo sapiens
  misc_feature (24)..(24): n is a, c, g, or t
  misc_feature (27)..(27): n is a, c, g, or t
aactataggcaagtagcgaggctnggngttaatcggccgaggggctgtccctatggcaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458176 - DNA, 1373 bp, Homo sapiens
catatagttgactcgcattctcgactctgaggttcttttgcaacgtctgttgaaacagtgagcaaaatctgggccctatgtcgtgagggaatcatagaaaaatagccacatttacacggtgtggggaactcgcacgtggtgtcatagagatttactctcagcattgggtgtttttcctggaaggttataccatttgggtggaatcataatatgtacgtgagatctggaaagggaagagtcggataatccaaagtaaaatatttacggaattgggtaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458177 - DNA, 1224 bp, Homo sapiens
gtagctataacagggaaatagtatgacttgggtacacttctctgttaggccctacagaacaggaggggaatcttacttttaccaaaggtagaaatcactcagtgtgttctagtctaccagctgcctcatttagccattggcttgaacaagggaatggataagggagtgatttgtcccgagttgctgtagccttttggggaaagagaccggggttatctatcccctctccaggctgcccttgtcttctggactcaggtggtgtgcacaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458178 - DNA, 1735 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatgtggaagcaaaggcaggccagccttcttatcaatttgaggggcccttcattagtcaaggtgctttttacctttggtttttcctaaggtcgacaaaaaaaaaagggggggtaagataccggggggcccattggcgtccggtttgtcaagggcccagggagagtataagagagcgcgggggttaaaggtgtgggaagcttgcgttggcggaccctgtggggggggcacccacaataagggaaaattgtgtgtgacacgcttgcggggcgtctcaagaga

SEQ ID NO: 458179 - DNA, 1508 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458180 - DNA, 1458 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggaagccacaagcagcccagccctccttaatcaacttcaaggagcaccttcattagtacagcttgcatatttaacattttgtatttcaataaaagtgaagacaa

SEQ ID NO: 458181 - DNA, 3448 bp, Homo sapiens
  misc_feature (1827)..(1827): n is a, c, g, or t
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtggtgagtgctgagactgaacatctaacagttatgaaggtgtatgcagaggattgtgatgtttggtttatatttaggggcaacattcttaaacctcatccagtgtaaagaaagtacattgaattctaaagaaactctacctaagggtctggtataacaagaaattgtctcatcaaaattagtggagaaatttctgttcaattttatccacagtaagtggtgaaggagatcatcagaatccctaaatcaaagttaaacagaaatactcaaactttggaatggaatcattttcatgatagcttgatttgtaaatgttttacagaaattttgacattgtgtggtttgagaagaatttcatttgaaactggggccattatgtaaaacagcatccctttttcttataattattgagggggaaattagtaaagagatcaggggactgtagaatgttgcagtgccactttgctccaaagattcaattgcctcatggctggctgaggatggtggctcatgcctataatcccaacactttgggaggccaagacaggaggatggcttgaggccaggaatttgagaccaattgtctgatagctcttgggagctatttttcaaaagaaaacagattttttttctagaaaatggtaaattcaagatgatttcactatcagtaggcacattgttgaatgacactggagagaaagaaaagtggtgtgtgtgtgtgtgtgtctntctctgtgtgtgtttgtatgtgtgtgggtctgtatgtatgaaactagtaagaatgaacattcaaaaagaacaaggtgggcaactgtgacagccattctgtgggaggcacagcagtgtgcagaaagttaatgtctccatagcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtaagtgtctcttttctagttactcatttatttcttcaggaagaatttgtcatgattcactttttacttcacaatgacaatttttgtcagggaagtgaaagtagagaggtacccagtttctgtcattcagttgtttaaaatatggctaaggaaaagacaattccaatatatcccagcagaagatcaaagtaaaataaaataatatcaaccataagctttatgttatggagcgtaagttcttaagttttagagaaggaaaaatattttgaaataatttttatttcttaatttattaaatgaataaaatctgggtggtctgctaggtcatggatttcctcctggtgacagaggggtaaatgaggcctacatgacgtaatcctatctaggactcacattttcgtgggagatatggatactgaaaatgtgggttaacaaacaaatatgtgcttacagattgtgataggatccataaagacatgtgagagggaacaaaaaagaagtcattctttcaataaaaaagtgcagaaggaaaggtttgctacttcttgcccaacttgggacattccttattcccactacttcctatgttatttttctccatagctcgtacatctacccactcagcaaatattaatagtttatttatgtgtctggttttttacttgtatttactcactaacatgcaaacttcgtgatggcagggatttgctcagcaattcaacaaacctggcacgtagcagatattcaattaataattattgaataaatacatgcataaatacacagataaatgcaccctcttgtttaaagagaaaatgggattggtattaacacagaatagtataattattaataaagtaaaaattgtagagaacagtaaaactcctgcgggaaaagaaagatacacctctggcgtttatagaagaaagccatccagaaccagcacagtcactcattcctgtaatcccagcactctgggagtccgaaggagggtggagtggcttgaacccaggaatttgaggccaacctgggcaacatggcaaaacccatctctacaaaaaatacaaaaattagccgggcatattgactggaacctgtaatccgagctacctgagagctgagatgggagaatcgcttgagctcaggaagcggaggttgcaatgagctgagatttcaccactaccctctagcctggatgacagagtaagaccctgtcttaaaaaaaga

SEQ ID NO: 458182 - DNA, 623 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcattggaaccctttttgaaagaaaaaccacgttgggggagaaaaggtgcttttaaaacttttttatataaaacaacaatttctccccccaaaaaagggggtaattggttgccacacggaggaataccaaactatgt

SEQ ID NO: 458183 - DNA, 887 bp, Homo sapiens
cttggtgctaagagctattcctaacgttgggaataggtctgtaaatgagacaggaagttcccagccagcattcatctaggttacagtagagagaaacagtgaaattgtaagaaaaaagacaacttcaagcaccaggtgtgcatatgtgtgtctacaaaacagcgacaagacagccaaaagtaagtaaaaagaaaataaaaaggaaatatgagacagaattgtagggtggggagcaacgtttttgggttggttggagatggctctggaaagacatgaatgcagcgccttcaaagtaggagacgccacctgtgaaagagctgagctgaaaatgaacctggcacacgagaagcacaaagagaagaccagtgtgactagaggttgaaggagaaggaacatagtatgagggtggtgtatggtcaggccagaagtttgattctattctaagcatagtgggatggattttacaaagaacatggtgtgttgcatttataacacatgacttgctaggtaaggagatagaagattgagatggaaaagaaaaagtaacatgagtaacacatagcaatatacaatatactaagaagacagtatgtcagcaggaagagaaaatgggaatccacggccccataaagaaggaaaaataaaaccattaaacagctgtcatgactgagtaagcactaagtgaagcaccacgacctggatgttacatatgtttcttgtttcgctcatggtaaatctaggagtcccctttaattgtgatgcttctctgactgaagttagacattgctcttttacaggatatggagtcagcgctgagggcatttgctaccagaccagagcacaagtcctctgacagcacattcttggtactcatgtctcatggcatc

SEQ ID NO: 458184 - DNA, 1562 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458185 - DNA, 5541 bp, Homo sapiens
  misc_feature (1827)..(1827): n is a, c, g, or t
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtggtgagtgctgagactgaacatctaacagttatgaaggtgtatgcagaggattgtgatgtttggtttatatttaggggcaacattcttaaacctcatccagtgtaaagaaagtacattgaattctaaagaaactctacctaagggtctggtataacaagaaattgtctcatcaaaattagtggagaaatttctgttcaattttatccacagtaagtggtgaaggagatcatcagaatccctaaatcaaagttaaacagaaatactcaaactttggaatggaatcattttcatgatagcttgatttgtaaatgttttacagaaattttgacattgtgtggtttgagaagaatttcatttgaaactggggccattatgtaaaacagcatccctttttcttataattattgagggggaaattagtaaagagatcaggggactgtagaatgttgcagtgccactttgctccaaagattcaattgcctcatggctggctgaggatggtggctcatgcctataatcccaacactttgggaggccaagacaggaggatggcttgaggccaggaatttgagaccaattgtctgatagctcttgggagctatttttcaaaagaaaacagattttttttctagaaaatggtaaattcaagatgatttcactatcagtaggcacattgttgaatgacactggagagaaagaaaagtggtgtgtgtgtgtgtgtgtctntctctgtgtgtgtttgtatgtgtgtgggtctgtatgtatgaaactagtaagaatgaacattcaaaaagaacaaggtgggcaactgtgacagccattctgtgggaggcacagcagtgtgcagaaagttaatgtctccatagcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacgtatgtatctttcagtggcagtaagggatttgtgggcctgaggccatctttgaatgaatctagaaaatcaagaatccctatgaaacaatgatctgatagaatgttgtgtgctctccacatattttacatgatcttatgtgtgccgtgagaacagattcctaaagcaacccgatacatggaaacccattcaccactcaccatttaaacagatgatgaattctgttttttttattaagcccatttaacattttacatagtgtttttatggattccaggaatggcttctctttctcaaatgatcaacttcaagtcttctttccatatttcacatctgattatacaatgagcagtgccattgcatgccctgctagaactgtggataccctttaaaacaagtagaaaatgatagggtggggctgattaggtctaatctcagggaacactggttagtatttcatgtctaggtaattatcttaaggagcgtacatttaactgtttttgatttgtatatttttaaatcttattttttaaaaccactttattgaggtatgattgacatacataatgttacatatttaatgtatacaacttaatgagtttggagatttctatgtactcctgaaatcatcaccactatctatgccataaacatatctctcttctccaaaagattcttacacttctctgtttattattatcatcattccgtgactgcgtgtgagaagtatacttagcataaaatctactctcttaacaaatttcaagtacataacacaatgttggttactactggcaccatcctgtacaatagatttttatcacttttttcagcttctatcactgaaacttgtcatgtgttcatctatttctattatacggtgaaagacagtgtggcataatctgcaaacaactttggagcctggtggcaattttttgttgcttactcactgtgtgaacatggggaagttccttcatctttctgtgcttctatttcttcctctgtaaagtgggataattctagttatttctcaagcccctataaaagctgagagaatgaacatgagttttgtagtagaaagccaatcccaagaatcaaaatttcttcaatacacaatctcttgcaatgcttaccaactgcaacttttgatcaccttttgctaggttttctgtttacgttctgtggaaagtaggtaaatgtcaggttgtaagtgcttcctacaaatctgtaaagataattcccaagctatgcttttctttttaaaaacattctcaaaacaaaaatatgaacaaaaacatagtgaaagtcatagcccaaggcatacccatctgtatcattatagacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatgggttaagtattgagagttgttggtggtatgtgaaataaataagagagtgatattggtggttaagttcaatgacaaatgacagctgagtacttggatggtcaaattggtgtttttgttgatatagtctggtgattatctgctacttctttccgacttacatgtatttggattcctccaactctacaattaatcaggcaatcaatcaatcaatcaaggaggtaaggaaaaccgcagcagaatgtgatgatgaaaaaccaaggatagtaattattaaaatagaaacatgctcatgcttccattactatttatattcatttatctctcatagtctttctcttttattcccctttcttacacacacacacacacacacacacagagagagagagagagagagagagacactaagtagccaaacattgcatcaaaccctaaacaaaacagagtaaacaaaggagctaactctggagaaagcagcattttgatcctctgagtgaggatgtcacagcaaataccacattactgacatccagataccattaccagatggtacagaatacatcctacactgtagagtttgtgttgatccaggctctggttctcagactgttctcacaatgcagatcaccaatcactcagggttggcttttgaatcttcaatcacagtccagaagttccttcaagctcccatgtaacttttgttattattttgaccaaaatattatagaatgggtacattgagtctggactaaatgattactttcttcactcataatagctttatttaacactagactataagactattatcaatctccctctaagatacatacttaaaattatattttatagtgaaatgtataaagttgttctcaatacttccaacatttaccacataatttttactcttggtttctgacacttcagtcacaatattgcatcatttcagcataacagctttcagtgcctaatccatccagtggggctgcatttggacattgaattgtttgttgactaatatttgccaacactaactgtgcaccaggttttgttctagatgcttggaatatgccaattaacaacgtaaatagatttcttacactctgaaagcttatattctagtgagtagaaacagactctgaagacataaagtggtaaatatatcacaggccagagagcaaaaaaaggtaaaaggaaaaataaaggaagacaaaggaaaacacagaatgatggatgctgtactcctatagatatttcactcaaaagcttttcttgaaataatgaaatcagaacaaagaatggacagagttggggagtgaataatgtggttcttatgcaggaaaagtgttccagcacagaatacagccagtgcaaatgccctgggatagcaatgcactaaacatgtttaaagaactgcaatgagacagtgtgaccaaaagagaacgtgagtggagaaaatggcagagacaaattaggagaagcagtgagaagccagatcgcgtggttctatgttatcacatggtaaacctttaaaaattattatctgagcgagacaggaagcctttctagtgctttagaaaaaagaaataatatgctttaaattaggttttacaaagatcacattttggtgaatagactaagatgtcacagatggaagtcaagggaagtggcaagagcacatggaagaggatgcaagaagaatcatgatgagggatgggatgaaggcagcaaggggtaaccatcttgaccttctgttttttctctcccctgcaggaagccacaagcagcccagccctccttaatcaacttcaaggagcaccttcattagtacagcttgcatatttaacattttgtatttcaataaaagtgaagacaa

SEQ ID NO: 458186 - DNA, 1194 bp, Homo sapiens
tactcgtggcattgcatgcagagtgcttggggataatcggtgagagtaatgtagttgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa

SEQ ID NO: 458187 - DNA, 1617 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaatggacaaccacaacaacgacgacaaaaccctttcggggcgcactgggctctggaa

SEQ ID NO: 458188 - DNA, 1514 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaa
